United States Patent 12,442,020 (MATERIALS AND METHODS FOR TREATMENT OF PAIN RELATED DISORDERS) - sequence listing, part 9

SEQ ID NO: 110960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgacctcttcttttcaccc

SEQ ID NO: 110961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgacctcttcttttcacccc

SEQ ID NO: 110962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acctcttcttttcacccctg

SEQ ID NO: 110963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcttttcacccctgtatgc

SEQ ID NO: 110964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttttcacccctgtatgcac

SEQ ID NO: 110965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttcacccctgtatgcacc

SEQ ID NO: 110966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcacccctgtatgcacctt

SEQ ID NO: 110967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcacccctgtatgcacctta

SEQ ID NO: 110968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacccctgtatgcaccttat

SEQ ID NO: 110969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acccctgtatgcaccttatt

SEQ ID NO: 110970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatgcaccttattcttacct

SEQ ID NO: 110971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attcttaccttgaaccctac

SEQ ID NO: 110972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcttaccttgaaccctacc

SEQ ID NO: 110973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaccttgaaccctaccact

SEQ ID NO: 110974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
accttgaaccctaccactta

SEQ ID NO: 110975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccttgaaccctaccacttac

SEQ ID NO: 110976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaccctaccacttacccaa

SEQ ID NO: 110977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaccctaccacttacccaaa

SEQ ID NO: 110978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccacttacccaaattttctc

SEQ ID NO: 110979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acccaaattttctcaagaaa

SEQ ID NO: 110980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccaaattttctcaagaaat

SEQ ID NO: 110981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctcaagaaattctctgatg

SEQ ID NO: 110982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcaagaaattctctgatga

SEQ ID NO: 110983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaagaaattctctgatgac

SEQ ID NO: 110984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagaaattctctgatgactt

SEQ ID NO: 110985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgatgacttccctgttac

SEQ ID NO: 110986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgatgacttccctgttactt

SEQ ID NO: 110987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgacttccctgttacttaa

SEQ ID NO: 110988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctgttacttaacctaatg

SEQ ID NO: 110989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctgttacttaacctaatgc

SEQ ID NO: 110990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttacttaacctaatgcatat

SEQ ID NO: 110991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttaacctaatgcatatttc

SEQ ID NO: 110992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacctaatgcatatttcttt

SEQ ID NO: 110993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acctaatgcatatttctttc

SEQ ID NO: 110994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgcatatttctttcttcat

SEQ ID NO: 110995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcttcatcatccttact

SEQ ID NO: 110996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcttcatcatccttactc

SEQ ID NO: 110997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttcatcatccttactcct

SEQ ID NO: 110998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcatcatccttactcctt

SEQ ID NO: 110999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcatcatccttactccttg

SEQ ID NO: 111000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catcatccttactccttgat

SEQ ID NO: 111001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcatccttactccttgatc

SEQ ID NO: 111002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actccttgatcttgcagcat

SEQ ID NO: 111003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctccttgatcttgcagcatg

SEQ ID NO: 111004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttgatcttgcagcatgatt

SEQ ID NO: 111005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatcttgcagcatgattcta

SEQ ID NO: 111006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcttgcagcatgattctac

SEQ ID NO: 111007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcagcatgattctacacaag

SEQ ID NO: 111008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagcatgattctacacaagc

SEQ ID NO: 111009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacacaagcacatctgtttc

SEQ ID NO: 111010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacaagcacatctgtttcta

SEQ ID NO: 111011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttctacaatatgttttctt

SEQ ID NO: 111012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctacaatatgttttcttctc

SEQ ID NO: 111013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacaatatgttttcttctct

SEQ ID NO: 111014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caatatgttttcttctcttg

SEQ ID NO: 111015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttctcttggcttcattat

SEQ ID NO: 111016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttctcttggcttcattatt

SEQ ID NO: 111017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctcttggcttcattattt

SEQ ID NO: 111018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcttggcttcattatttat

SEQ ID NO: 111019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttggcttcattatttata

SEQ ID NO: 111020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttggcttcattatttatatc

SEQ ID NO: 111021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcttcattatttatatctt

SEQ ID NO: 111022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcttcattatttatatcttt

SEQ ID NO: 111023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattatttatatctttgctt

SEQ ID NO: 111024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attatttatatctttgcttc

SEQ ID NO: 111025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatatctttgcttcttac

SEQ ID NO: 111026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatctttgcttcttacttt

SEQ ID NO: 111027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatctttgcttcttacttta

SEQ ID NO: 111028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcttcttactttattggcg

SEQ ID NO: 111029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttcttactttattggcgg

SEQ ID NO: 111030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttcttactttattggcggc

SEQ ID NO: 111031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttactttattggcggctct

SEQ ID NO: 111032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttactttattggcggctctt

SEQ ID NO: 111033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actttattggcggctctttc

SEQ ID NO: 111034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttattggcggctctttct

SEQ ID NO: 111035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattggcggctctttctctg

SEQ ID NO: 111036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attggcggctctttctctgt

SEQ ID NO: 111037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttggcggctctttctctgtg

SEQ ID NO: 111038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcggctctttctctgtgttc

SEQ ID NO: 111039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttctctgtgttcttttctg

SEQ ID NO: 111040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctctgtgttcttttctggg

SEQ ID NO: 111041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctgtgttcttttctgggt

SEQ ID NO: 111042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgtgttcttttctgggtc

SEQ ID NO: 111043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtgttcttttctgggtcct

SEQ ID NO: 111044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgttcttttctgggtcctct

SEQ ID NO: 111045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttctgggtcctcttttct

SEQ ID NO: 111046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctgggtcctcttttctac

SEQ ID NO: 111047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgggtcctcttttctacc

SEQ ID NO: 111048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgggtcctcttttctacct

SEQ ID NO: 111049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgggtcctcttttctacctg

SEQ ID NO: 111050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtcctcttttctacctgaa

SEQ ID NO: 111051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttctacctgaattctaaa

SEQ ID NO: 111052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctacctgaattctaaatg

SEQ ID NO: 111053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctacctgaattctaaatgt

SEQ ID NO: 111054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctacctgaattctaaatgtc

SEQ ID NO: 111055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacctgaattctaaatgtca

SEQ ID NO: 111056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctgaattctaaatgtcaga

SEQ ID NO: 111057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aattctaaatgtcagagttg

SEQ ID NO: 111058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaatgtcagagttgtagat

SEQ ID NO: 111059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatgtcagagttgtagatct

SEQ ID NO: 111060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagatcttggtaccagattg

SEQ ID NO: 111061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtaccagattgctttaaat

SEQ ID NO: 111062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtaccagattgctttaaata

SEQ ID NO: 111063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttaaataccaggtttccc

SEQ ID NO: 111064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaataccaggtttcccatt

SEQ ID NO: 111065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaataccaggtttcccattc

SEQ ID NO: 111066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataccaggtttcccattct

SEQ ID NO: 111067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccattctctatctacttaa

SEQ ID NO: 111068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccattctctatctacttaaa

SEQ ID NO: 111069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctatctacttaaaaatatc

SEQ ID NO: 111070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatctacttaaaaatatcag

SEQ ID NO: 111071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctacttaaaaatatcaggg

SEQ ID NO: 111072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttaaaaatatcagggatgt

SEQ ID NO: 111073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaaatatcagggatgttca

SEQ ID NO: 111074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatatcagggatgttcag

SEQ ID NO: 111075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaggtagaggtgtgtgtgt

SEQ ID NO: 111076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttttgctgattgctctg

SEQ ID NO: 111077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttttgctgattgctctgg

SEQ ID NO: 111078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttgctgattgctctgga

SEQ ID NO: 111079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttgctgattgctctggaat

SEQ ID NO: 111080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgctgattgctctggaatt

SEQ ID NO: 111081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctgattgctctggaattt

SEQ ID NO: 111082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctgattgctctggaattta

SEQ ID NO: 111083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgattgctctggaatttat

SEQ ID NO: 111084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attgctctggaatttatctc

SEQ ID NO: 111085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctctggaatttatctccaaa

SEQ ID NO: 111086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tggaatttatctccaaactc

SEQ ID NO: 111087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaatttatctccaaactcag

SEQ ID NO: 111088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctccaaactcagcaggcc

SEQ ID NO: 111089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctccaaactcagcaggccc

SEQ ID NO: 111090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caaactcagcaggccctctg

SEQ ID NO: 111091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcaggccctctgatttcta

SEQ ID NO: 111092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgatttctatacttaaatct

SEQ ID NO: 111093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atttctatacttaaatctcc

SEQ ID NO: 111094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatacttaaatctccaatt

SEQ ID NO: 111095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatacttaaatctccaattc

SEQ ID NO: 111096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tacttaaatctccaattctc

SEQ ID NO: 111097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaatctccaattctctatat

SEQ ID NO: 111098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatctccaattctctatatt

SEQ ID NO: 111099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caattctctatattatatat

SEQ ID NO: 111100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctatattatatatccacct

SEQ ID NO: 111101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatattatatatccacctgg

SEQ ID NO: 111102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tattatatatccacctggac

SEQ ID NO: 111103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatatccacctggacatctc

SEQ ID NO: 111104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gacatctcaaaggcatctca

SEQ ID NO: 111105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaggcatctcattttaatt

SEQ ID NO: 111106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attttaattttagctagcta

SEQ ID NO: 111107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattttagctagctaatag

SEQ ID NO: 111108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattttagctagctaatagt

SEQ ID NO: 111109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttagctagctaatagtg

SEQ ID NO: 111110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagctagctaatagtgacct

SEQ ID NO: 111111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agctagctaatagtgacctt

SEQ ID NO: 111112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctagctaatagtgaccttc

SEQ ID NO: 111113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctaatagtgaccttcctct

SEQ ID NO: 111114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atagtgaccttcctctacaa

SEQ ID NO: 111115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctctacaaatgtgtccacc

SEQ ID NO: 111116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctctacaaatgtgtccacca

SEQ ID NO: 111117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tacaaatgtgtccaccattt

SEQ ID NO: 111118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaatgtgtccaccatttcc

SEQ ID NO: 111119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctcattaaccatcaccacc

SEQ ID NO: 111120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcattaaccatcaccaccc

SEQ ID NO: 111121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attaaccatcaccacccatc

SEQ ID NO: 111122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
accatcaccacccatccagt

SEQ ID NO: 111123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgcagccagaaactgagaa

SEQ ID NO: 111124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagccagaaactgagaagtc

SEQ ID NO: 111125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaagtcatcctcaatgctt

SEQ ID NO: 111126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatgcttcctgtcttcttta

SEQ ID NO: 111127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctgtcttctttaatccatc

SEQ ID NO: 111128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgtcttctttaatccatca

SEQ ID NO: 111129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcttctttaatccatcagca

SEQ ID NO: 111130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttaatccatcagcaagct

SEQ ID NO: 111131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttaatccatcagcaagctc

SEQ ID NO: 111132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taatccatcagcaagctcta

SEQ ID NO: 111133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatccatcagcaagctctac

SEQ ID NO: 111134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atccatcagcaagctctaca

SEQ ID NO: 111135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tacagactttgtatgttgag

SEQ ID NO: 111136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagactttgtatgttgagct

SEQ ID NO: 111137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtatgttgagctcatcttt

SEQ ID NO: 111138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatgttgagctcatctttt

SEQ ID NO: 111139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatgttgagctcatcttttt

SEQ ID NO: 111140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agctcatcttttttctcttc

SEQ ID NO: 111141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atcttttttctcttcatttc

SEQ ID NO: 111142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttctcttcatttctctgc

SEQ ID NO: 111143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctcttcatttctctgcc

SEQ ID NO: 111144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctcttcatttctctgcca

SEQ ID NO: 111145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctcttcatttctctgccat

SEQ ID NO: 111146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcttcatttctctgccatc

SEQ ID NO: 111147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttcatttctctgccatca

SEQ ID NO: 111148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcatttctctgccatcact

SEQ ID NO: 111149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catttctctgccatcactct

SEQ ID NO: 111150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttctctgccatcactcta

SEQ ID NO: 111151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctgccatcactctagatg

SEQ ID NO: 111152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgccatcactctagatga

SEQ ID NO: 111153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgccatcactctagatgaaa

SEQ ID NO: 111154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccatcactctagatgaaacc

SEQ ID NO: 111155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagatgaaacctttattttc

SEQ ID NO: 111156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatgaaacctttattttctc

SEQ ID NO: 111157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattttctcttgcctagatg

SEQ ID NO: 111158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttctcttgcctagatga

SEQ ID NO: 111159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttctcttgcctagatgag

SEQ ID NO: 111160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctcttgcctagatgagaga

SEQ ID NO: 111161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcttgcctagatgagagaa

SEQ ID NO: 111162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttgcctagatgagagaag

SEQ ID NO: 111163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgcctagatgagagaagca

SEQ ID NO: 111164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcctagatgagagaagcaac

SEQ ID NO: 111165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctagatgagagaagcaacc

SEQ ID NO: 111166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatgagagaagcaaccttca

SEQ ID NO: 111167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caacttacctttcttattcc

SEQ ID NO: 111168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacttacctttcttattccc

SEQ ID NO: 111169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acctttcttattcccatcta

SEQ ID NO: 111170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctttcttattcccatctac

SEQ ID NO: 111171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttattcccatctaccatc

SEQ ID NO: 111172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttattcccatctaccatct

SEQ ID NO: 111173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttattcccatctaccatcta

SEQ ID NO: 111174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attcccatctaccatctacc

SEQ ID NO: 111175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcccatctaccatctaccc

SEQ ID NO: 111176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccatctaccatctacccttg

SEQ ID NO: 111177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccatctacccttgctcaatc

SEQ ID NO: 111178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cccttgctcaatcagttgtg

SEQ ID NO: 111179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctcaatcagttgtgcacaa

SEQ ID NO: 111180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcaatcagttgtgcacaag

SEQ ID NO: 111181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatcagttgtgcacaagaca

SEQ ID NO: 111182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgcacaagacagacagcaat

SEQ ID NO: 111183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catttaaaataaaatacaaa

SEQ ID NO: 111184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaataaaatacaaactcct

SEQ ID NO: 111185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaataaaatacaaactcctt

SEQ ID NO: 111186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttcccatgggctgaaatgt

SEQ ID NO: 111187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccatgggctgaaatgtcct

SEQ ID NO: 111188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccatgggctgaaatgtcctg

SEQ ID NO: 111189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaatgtcctgcatgatatga

SEQ ID NO: 111190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catgatatgacccctatttt

SEQ ID NO: 111191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttttctgctactttctct

SEQ ID NO: 111192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctgctactttctctgtt

SEQ ID NO: 111193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctgctactttctctgttg

SEQ ID NO: 111194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgctactttctctgttgc

SEQ ID NO: 111195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgctactttctctgttgcc

SEQ ID NO: 111196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgctactttctctgttgcca

SEQ ID NO: 111197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctactttctctgttgccatt

SEQ ID NO: 111198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctttctctgttgccattctt

SEQ ID NO: 111199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctctgttgccattcttcct

SEQ ID NO: 111200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctgttgccattcttcctt

SEQ ID NO: 111201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgttgccattcttccttt

SEQ ID NO: 111202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgttgccattcttcctttct

SEQ ID NO: 111203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgccattcttcctttctct

SEQ ID NO: 111204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccattcttcctttctcttac

SEQ ID NO: 111205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcctttctcttaccaaacc

SEQ ID NO: 111206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctttctcttaccaaaccac

SEQ ID NO: 111207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttctcttaccaaaccacg

SEQ ID NO: 111208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctcttaccaaaccacgctg

SEQ ID NO: 111209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcttaccaaaccacgctgc

SEQ ID NO: 111210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttaccaaaccacgctgct

SEQ ID NO: 111211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaccaaaccacgctgctgt

SEQ ID NO: 111212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
accaaaccacgctgctgttt

SEQ ID NO: 111213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccaaaccacgctgctgtttt

SEQ ID NO: 111214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctgtttttccattctttaaa

SEQ ID NO: 111215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttttccattctttaaaccc

SEQ ID NO: 111216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccattctttaaacccata

SEQ ID NO: 111217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccattctttaaacccatac

SEQ ID NO: 111218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccattctttaaacccatacc

SEQ ID NO: 111219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattctttaaacccataccc

SEQ ID NO: 111220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttaaacccataccctccct

SEQ ID NO: 111221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaacccataccctcccttt

SEQ ID NO: 111222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaacccataccctcccttta

SEQ ID NO: 111223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacccataccctccctttat

SEQ ID NO: 111224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctttattcaggacctttgc

SEQ ID NO: 111225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattcaggacctttgcccat

SEQ ID NO: 111226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attcaggacctttgcccatg

SEQ ID NO: 111227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcaggacctttgcccatgc

SEQ ID NO: 111228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggacctttgcccatgctat

SEQ ID NO: 111229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcccatgctatttctccta

SEQ ID NO: 111230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcccatgctatttctcctaa

SEQ ID NO: 111231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccatgctatttctcctaat

SEQ ID NO: 111232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttctcctaattgaagcagc

SEQ ID NO: 111233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcctaattgaagcagcacc

SEQ ID NO: 111234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctaattgaagcagcaccc

SEQ ID NO: 111235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctaattgaagcagcaccccc

SEQ ID NO: 111236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attgaagcagcaccccccac

SEQ ID NO: 111237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagcagcaccccccacacat

SEQ ID NO: 111238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acacccacacttaaactatt

SEQ ID NO: 111239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaactattttatggcttctt

SEQ ID NO: 111240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aactattttatggcttctta

SEQ ID NO: 111241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttatggcttcttactatc

SEQ ID NO: 111242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatggcttcttactatcttt

SEQ ID NO: 111243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atggcttcttactatctttt

SEQ ID NO: 111244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggcttcttactatctttta

SEQ ID NO: 111245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttactatcttttagatctc

SEQ ID NO: 111246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttactatcttttagatctca

SEQ ID NO: 111247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actatcttttagatctcagc

SEQ ID NO: 111248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctatcttttagatctcagct

SEQ ID NO: 111249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcttttagatctcagcttaa

SEQ ID NO: 111250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttagatctcagcttaaatgc

SEQ ID NO: 111251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagatctcagcttaaatgcc

SEQ ID NO: 111252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agatctcagcttaaatgcca

SEQ ID NO: 111253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatctcagcttaaatgccat

SEQ ID NO: 111254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcttaaatgccatcacctc

SEQ ID NO: 111255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaatgccatcacctcagaga

SEQ ID NO: 111256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgccatcacctcagagat

SEQ ID NO: 111257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agagatgtcttctcatctag

SEQ ID NO: 111258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcatctagttgatatctca

SEQ ID NO: 111259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcatctagttgatatctcag

SEQ ID NO: 111260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atctagttgatatctcagca

SEQ ID NO: 111261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gttgatatctcagcacctga

SEQ ID NO: 111262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atatctcagcacctgagact

SEQ ID NO: 111263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcacctgagactcacttcc

SEQ ID NO: 111264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agactcacttcctttgcatg

SEQ ID NO: 111265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acttcctttgcatggcattt

SEQ ID NO: 111266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctttgcatggcatttatta

SEQ ID NO: 111267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttgcatggcatttattat

SEQ ID NO: 111268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcatggcatttattataac

SEQ ID NO: 111269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcatggcatttattataact

SEQ ID NO: 111270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catggcatttattataactt

SEQ ID NO: 111271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attataacttgagatatttt

SEQ ID NO: 111272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttataacttgagatattttt

SEQ ID NO: 111273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taacttgagatatttttaat

SEQ ID NO: 111274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagatatttttaatttattt

SEQ ID NO: 111275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agatatttttaatttatttg

SEQ ID NO: 111276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaatttatttgtctgttcc

SEQ ID NO: 111277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatttatttgtctgttccc

SEQ ID NO: 111278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttatttgtctgttcccc

SEQ ID NO: 111279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttatttgtctgttccccc

SEQ ID NO: 111280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttgtctgttcccccttaa

SEQ ID NO: 111281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgtctgttcccccttaaa

SEQ ID NO: 111282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtctgttcccccttaaacat

SEQ ID NO: 111283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctgttcccccttaaacatt

SEQ ID NO: 111284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttcccccttaaacatttttt

SEQ ID NO: 111285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccccttaaacattttttttc

SEQ ID NO: 111286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaacattttttttcattccc

SEQ ID NO: 111287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacattttttttcattccca

SEQ ID NO: 111288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttcattcccactagatg

SEQ ID NO: 111289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttcattcccactagatga

SEQ ID NO: 111290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcattcccactagatgat

SEQ ID NO: 111291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcattcccactagatgata

SEQ ID NO: 111292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattcccactagatgataa

SEQ ID NO: 111293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattcccactagatgataag

SEQ ID NO: 111294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attcccactagatgataagc

SEQ ID NO: 111295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccactagatgataagctctg

SEQ ID NO: 111296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatgataagctctgtgaaag

SEQ ID NO: 111297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtgaaagcaagggctgagg

SEQ ID NO: 111298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgaaagcaagggctgaggct

SEQ ID NO: 111299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggctatcatttattgctat

SEQ ID NO: 111300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcatttattgctatagctca

SEQ ID NO: 111301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgctatagctcagggaaa

SEQ ID NO: 111302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgctatagctcagggaaac

SEQ ID NO: 111303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctatagctcagggaaaccat

SEQ ID NO: 111304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagctcagggaaaccatgta

SEQ ID NO: 111305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agggaaaccatgtaataaac

SEQ ID NO: 111306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaatcaattatgcagtcaaa

SEQ ID NO: 111307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatcaattatgcagtcaaaa

SEQ ID NO: 111308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcagtcaaaaatggcttct

SEQ ID NO: 111309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctatgacataggaaacagaa

SEQ ID NO: 111310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatgacataggaaacagaag

SEQ ID NO: 111311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgacataggaaacagaagca

SEQ ID NO: 111312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agacttgatttaaacacctc

SEQ ID NO: 111313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatttaaacacctcttcact

SEQ ID NO: 111314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atttaaacacctcttcacta

SEQ ID NO: 111315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaacacctcttcactaaaac

SEQ ID NO: 111316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacacctcttcactaaaact

SEQ ID NO: 111317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcactaaaactacatttca

SEQ ID NO: 111318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cactaaaactacatttcaga

SEQ ID NO: 111319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actaaaactacatttcagaa

SEQ ID NO: 111320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaactacatttcagaagaaa

SEQ ID NO: 111321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catttcagaagaaaataaag

SEQ ID NO: 111322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagaagaaaataaagaataa

SEQ ID NO: 111323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaagaaaataaagaataat

SEQ ID NO: 111324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaagacaggattgtggtat

SEQ ID NO: 111325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaagacaggattgtggtata

SEQ ID NO: 111326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggtataagattcattatta

SEQ ID NO: 111327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attattagctaattgtcatg

SEQ ID NO: 111328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttagctaattgtcatgcatt

SEQ ID NO: 111329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctaattgtcatgcattcat

SEQ ID NO: 111330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attgtcatgcattcatgttt

SEQ ID NO: 111331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcatgcattcatgtttaaat

SEQ ID NO: 111332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtttaaatataatataaa

SEQ ID NO: 111333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatataatataaagataat

SEQ ID NO: 111334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatataatataaagataatt

SEQ ID NO: 111335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acataactcaagggctctat

SEQ ID NO: 111336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagggctctattattattat

SEQ ID NO: 111337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tattattattattaatttat

SEQ ID NO: 111338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttattattattaatttatta

SEQ ID NO: 111339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattattaatttattaatt

SEQ ID NO: 111340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattaatttattaatttat

SEQ ID NO: 111341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaatttattaatttattta

SEQ ID NO: 111342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttattaatttatttattt

SEQ ID NO: 111343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaatttatttatttttga

SEQ ID NO: 111344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaatttatttatttttgag

SEQ ID NO: 111345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttatttatttttgagaca

SEQ ID NO: 111346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttttgagacagttt

SEQ ID NO: 111347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttttgagacagtttc

SEQ ID NO: 111348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttttgagacagtttcgct

SEQ ID NO: 111349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttgagacagtttcgctc

SEQ ID NO: 111350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgagacagtttcgctcttg

SEQ ID NO: 111351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgagacagtttcgctcttgt

SEQ ID NO: 111352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagacagtttcgctcttgtt

SEQ ID NO: 111353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agacagtttcgctcttgttg

SEQ ID NO: 111354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgctcttgttgcccaggctg

SEQ ID NO: 111355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gctcttgttgcccaggctgg

SEQ ID NO: 111356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgttgcccaggctggagtg

SEQ ID NO: 111357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttgcccaggctggagtgca

SEQ ID NO: 111358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgcccaggctggagtgcaa

SEQ ID NO: 111359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccaggctggagtgcaatgg

SEQ ID NO: 111360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagtgcaatggcacgatctc

SEQ ID NO: 111361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggctcaccgcaacctctgcc

SEQ ID NO: 111362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
accgcaacctctgcctcccg

SEQ ID NO: 111363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcctcccgagttcaagcga

SEQ ID NO: 111364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctcccgagttcaagcgatt

SEQ ID NO: 111365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccgagttcaagcgattctcc

SEQ ID NO: 111366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagcgattctcctgcctcag

SEQ ID NO: 111367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctgcctcagcctcctgag

SEQ ID NO: 111368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgcctcagcctcctgagta

SEQ ID NO: 111369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctcagcctcctgagtagct

SEQ ID NO: 111370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcctcctgagtagctggaa

SEQ ID NO: 111371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgagtagctggaattacag

SEQ ID NO: 111372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtagctggaattacaggcg

SEQ ID NO: 111373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaattacaggcgcccaccac

SEQ ID NO: 111374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caggcgcccaccaccatgcc

SEQ ID NO: 111375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attttttgtatttttagtag

SEQ ID NO: 111376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgtatttttagtagagac

SEQ ID NO: 111377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtatttttagtagagacg

SEQ ID NO: 111378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtatttttagtagagacgg

SEQ ID NO: 111379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatttttagtagagacggg

SEQ ID NO: 111380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatttttagtagagacgggg

SEQ ID NO: 111381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagtagagacggggtttct

SEQ ID NO: 111382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagtagagacggggtttctt

SEQ ID NO: 111383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtagagacggggtttcttt

SEQ ID NO: 111384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtagagacggggtttctttt

SEQ ID NO: 111385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttttttttcttctttttt

SEQ ID NO: 111386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttttttcttcttttttt

SEQ ID NO: 111387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttttcttctttttttgt

SEQ ID NO: 111388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttcttctttttttgta

SEQ ID NO: 111389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttcttctttttttgtat

SEQ ID NO: 111390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttcttctttttttgtatt

SEQ ID NO: 111391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcttctttttttgtatta

SEQ ID NO: 111392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttctttttttgtattat

SEQ ID NO: 111393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttctttttttgtattatt

SEQ ID NO: 111394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttctttttttgtattattt

SEQ ID NO: 111395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctttttttgtattatttt

SEQ ID NO: 111396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttttttgtattatttttt

SEQ ID NO: 111397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttttgtattatttttta

SEQ ID NO: 111398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttgtattattttttagc

SEQ ID NO: 111399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttgtattattttttagca

SEQ ID NO: 111400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgtattattttttagcaa

SEQ ID NO: 111401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtattattttttagcaaa

SEQ ID NO: 111402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtattattttttagcaaaa

SEQ ID NO: 111403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtattattttttagcaaaaa

SEQ ID NO: 111404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattattttttagcaaaaaa

SEQ ID NO: 111405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttttagcaaaaaaaaaaa

SEQ ID NO: 111406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttagcaaaaaaaaaaaaaa

SEQ ID NO: 111407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagcaaaaaaaaaaaaaaa

SEQ ID NO: 111408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagcaaaaaaaaaaaaaaat

SEQ ID NO: 111409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcaaaaaaaaaaaaaaata

SEQ ID NO: 111410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaaaaaaaaaaaaaaatac

SEQ ID NO: 111411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagaaagcgatgaattaaat

SEQ ID NO: 111412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattaaatttgattaaaggc

SEQ ID NO: 111413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatttgattaaaggctgtct

SEQ ID NO: 111414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gattaaaggctgtctgtgta

SEQ ID NO: 111415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attaaaggctgtctgtgtac

SEQ ID NO: 111416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaggctgtctgtgtacatag

SEQ ID NO: 111417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctgtgtacatagagaattg

SEQ ID NO: 111418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtacatagagaattgcaat

SEQ ID NO: 111419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caatctaacttcatatgtaa

SEQ ID NO: 111420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acttcatatgtaaacaaatt

SEQ ID NO: 111421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catatgtaaacaaattgcat

SEQ ID NO: 111422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatgtaaacaaattgcatt

SEQ ID NO: 111423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattctaatctattagtata

SEQ ID NO: 111424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taatctattagtatattctt

SEQ ID NO: 111425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atctattagtatattcttgt

SEQ ID NO: 111426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttagtatattcttgtaacaa

SEQ ID NO: 111427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtatattcttgtaacaagta

SEQ ID NO: 111428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgtaacaagtagctgtctc

SEQ ID NO: 111429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaacaagtagctgtctcag

SEQ ID NO: 111430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taacaagtagctgtctcagc

SEQ ID NO: 111431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctcagccaatcacagcagc

SEQ ID NO: 111432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agccaatcacagcagctgag

SEQ ID NO: 111433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agcttcagccaaccacagcc

SEQ ID NO: 111434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagccaaccacagcctgctg

SEQ ID NO: 111435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agccaaccacagcctgctga

SEQ ID NO: 111436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctgatttatcagacaatgtc

SEQ ID NO: 111437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atttatcagacaatgtccac

SEQ ID NO: 111438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcagacaatgtccacataa

SEQ ID NO: 111439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcagacaatgtccacataag

SEQ ID NO: 111440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taagcaatcaagctgttttt

SEQ ID NO: 111441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttttgtgcgtcactccctt

SEQ ID NO: 111442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtgcgtcactcccttttt

SEQ ID NO: 111443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgcgtcactccctttttc

SEQ ID NO: 111444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgcgtcactccctttttct

SEQ ID NO: 111445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgcgtcactccctttttctg

SEQ ID NO: 111446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctttttctgtctataaata

SEQ ID NO: 111447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttctgtctataaatactcc

SEQ ID NO: 111448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctgtctataaatactcct

SEQ ID NO: 111449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgtctataaatactcctg

SEQ ID NO: 111450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtctataaatactcctgc

SEQ ID NO: 111451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtctataaatactcctgct

SEQ ID NO: 111452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctataaatactcctgctca

SEQ ID NO: 111453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaatactcctgctcatgtt

SEQ ID NO: 111454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgctcatgttgctgagttg

SEQ ID NO: 111455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctcatgttgctgagttgagc

SEQ ID NO: 111456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgttgctgagttgagctct

SEQ ID NO: 111457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgagttgagctctccgaac

SEQ ID NO: 111458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agttgagctctccgaacttc

SEQ ID NO: 111459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agctctccgaacttctcttg

SEQ ID NO: 111460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tccgaacttctcttggttct

SEQ ID NO: 111461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cgaacttctcttggttctga

SEQ ID NO: 111462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcttggttctgagtgctgc

SEQ ID NO: 111463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttggttctgagtgctgcc

SEQ ID NO: 111464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttggttctgagtgctgccta

SEQ ID NO: 111465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggttctgagtgctgcctaaa

SEQ ID NO: 111466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gttctgagtgctgcctaaat

SEQ ID NO: 111467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgagtgctgcctaaatcatt

SEQ ID NO: 111468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtgctgcctaaatcattat

SEQ ID NO: 111469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctaaatcattattattatt

SEQ ID NO: 111470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatcattattattattatct

SEQ ID NO: 111471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattattatcttatttcag

SEQ ID NO: 111472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattatcttatttcagcaa

SEQ ID NO: 111473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatcttatttcagcaataa

SEQ ID NO: 111474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttatttcagcaataaata

SEQ ID NO: 111475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttcagcaataaatactat

SEQ ID NO: 111476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcagcaataaatactatt

SEQ ID NO: 111477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagcaataaatactatttca

SEQ ID NO: 111478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agcaataaatactatttcat

SEQ ID NO: 111479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttcattgctgaaataagct

SEQ ID NO: 111480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattgctgaaataagctgct

SEQ ID NO: 111481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attgctgaaataagctgcta

SEQ ID NO: 111482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgaaataagctgctaaatt

SEQ ID NO: 111483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaataagctgctaaatttaa

SEQ ID NO: 111484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctaaatttaatttgttgaaa

SEQ ID NO: 111485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatttaatttgttgaaaatt

SEQ ID NO: 111486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttgttgaaaatttttct

SEQ ID NO: 111487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttgttgaaaatttttctt

SEQ ID NO: 111488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttgaaaatttttcttttaa

SEQ ID NO: 111489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgaaaatttttcttttaac

SEQ ID NO: 111490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaatttttcttttaacaaa

SEQ ID NO: 111491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttttaacaaaggttaag

SEQ ID NO: 111492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttttaacaaaggttaaga

SEQ ID NO: 111493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttaacaaaggttaagaa

SEQ ID NO: 111494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttaacaaaggttaagaaa

SEQ ID NO: 111495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaacaaaggttaagaaaac

SEQ ID NO: 111496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacaaaggttaagaaaacc

SEQ ID NO: 111497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacaaaggttaagaaaacca

SEQ ID NO: 111498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaaaggttaagaaaaccat

SEQ ID NO: 111499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaaaaccattcacagtata

SEQ ID NO: 111500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acagtataaactcagaaata

SEQ ID NO: 111501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaaataggagcaagactca

SEQ ID NO: 111502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaataaaaggacagatccc

SEQ ID NO: 111503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagtttaaataagtgtggta

SEQ ID NO: 111504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtttaaataagtgtggtaa

SEQ ID NO: 111505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaataagtgtggtaaaataa

SEQ ID NO: 111506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataagtgtggtaaaataat

SEQ ID NO: 111507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caatattaaatgtaagttac

SEQ ID NO: 111508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgtaagttactcatcaga

SEQ ID NO: 111509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcatcagatatattaattt

SEQ ID NO: 111510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atcagatatattaattttac

SEQ ID NO: 111511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttacagcatataaatta

SEQ ID NO: 111512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacagcatataaattaagaa

SEQ ID NO: 111513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acagcatataaattaagaaa

SEQ ID NO: 111514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagcatataaattaagaaat

SEQ ID NO: 111515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaaataaaattctccatcc

SEQ ID NO: 111516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccatccattggaaataagt

SEQ ID NO: 111517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catccattggaaataagttt

SEQ ID NO: 111518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaataagtttcaaatcatg

SEQ ID NO: 111519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaatcatgtttgtaacaat

SEQ ID NO: 111520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaatcatgtttgtaacaatc

SEQ ID NO: 111521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaacaatcagaaactggaa

SEQ ID NO: 111522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taacaatcagaaactggaaa

SEQ ID NO: 111523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaaagagggtaaatataaa

SEQ ID NO: 111524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattcctcatcaaatggtgg

SEQ ID NO: 111525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcatcaaatggtggtagta

SEQ ID NO: 111526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atcaaatggtggtagtaaaa

SEQ ID NO: 111527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacattttacttcaaaactt

SEQ ID NO: 111528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacttcaaaactttcagttt

SEQ ID NO: 111529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttcaaaactttcagtttt

SEQ ID NO: 111530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttcaaaactttcagttttc

SEQ ID NO: 111531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaaactttcagttttcttg

SEQ ID NO: 111532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaactttcagttttcttgt

SEQ ID NO: 111533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcagttttcttgttaaggct

SEQ ID NO: 111534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagttttcttgttaaggctt

SEQ ID NO: 111535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agttttcttgttaaggcttc

SEQ ID NO: 111536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttgttaaggcttctattt

SEQ ID NO: 111537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgttaaggcttctatttt

SEQ ID NO: 111538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgttaaggcttctattttt

SEQ ID NO: 111539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttaaggcttctattttttt

SEQ ID NO: 111540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaaggcttctatttttttc

SEQ ID NO: 111541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggcttctatttttttctgt

SEQ ID NO: 111542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctatttttttctgtcatttt

SEQ ID NO: 111543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatttttttctgtcatttta

SEQ ID NO: 111544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttttttctgtcattttatt

SEQ ID NO: 111545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttctgtcattttatttat

SEQ ID NO: 111546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctgtcattttatttata

SEQ ID NO: 111547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctgtcattttatttatag

SEQ ID NO: 111548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgtcattttatttatagt

SEQ ID NO: 111549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtcattttatttatagtc

SEQ ID NO: 111550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtcattttatttatagtct

SEQ ID NO: 111551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcattttatttatagtcttt

SEQ ID NO: 111552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttatagtcttttaccat

SEQ ID NO: 111553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatagtcttttaccatg

SEQ ID NO: 111554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatagtcttttaccatgt

SEQ ID NO: 111555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagtcttttaccatgtggg

SEQ ID NO: 111556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagtcttttaccatgtgggc

SEQ ID NO: 111557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaccatgtgggctaggtgt

SEQ ID NO: 111558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taccatgtgggctaggtgtt

SEQ ID NO: 111559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
accatgtgggctaggtgtta

SEQ ID NO: 111560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccatgtgggctaggtgttat

SEQ ID NO: 111561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtgttatttgattttattt

SEQ ID NO: 111562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgattttatttatcacag

SEQ ID NO: 111563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gattttatttatcacagtga

SEQ ID NO: 111564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attttatttatcacagtgag

SEQ ID NO: 111565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttatcacagtgagtgag

SEQ ID NO: 111566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatcacagtgagtgaga

SEQ ID NO: 111567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatcacagtgagtgagaa

SEQ ID NO: 111568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcacagtgagtgagaaagg

SEQ ID NO: 111569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcacagtgagtgagaaagga

SEQ ID NO: 111570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtaaaataagaaaatgatg

SEQ ID NO: 111571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtaaaataagaaaatgatgt

SEQ ID NO: 111572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttttattatctaaggaga

SEQ ID NO: 111573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttattatctaaggagaatc

SEQ ID NO: 111574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattatctaaggagaatcc

SEQ ID NO: 111575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattatctaaggagaatcct

SEQ ID NO: 111576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attatctaaggagaatcctg

SEQ ID NO: 111577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatctaaggagaatcctga

SEQ ID NO: 111578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctaaggagaatcctgacct

SEQ ID NO: 111579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aggagaatcctgacctttcc

SEQ ID NO: 111580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acctttcctccctcatttcc

SEQ ID NO: 111581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcctccctcatttccttttg

SEQ ID NO: 111582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctccctcatttccttttgg

SEQ ID NO: 111583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctccctcatttccttttggc

SEQ ID NO: 111584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctcatttccttttggcaac

SEQ ID NO: 111585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atttccttttggcaacagca

SEQ ID NO: 111586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttttggcaacagcacata

SEQ ID NO: 111587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttttggcaacagcacatat

SEQ ID NO: 111588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttggcaacagcacatatatt

SEQ ID NO: 111589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggcaacagcacatatattt

SEQ ID NO: 111590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcaacagcacatatatttg

SEQ ID NO: 111591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcaacagcacatatatttga

SEQ ID NO: 111592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaggtttcgtgacttcca

SEQ ID NO: 111593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaggtttcgtgacttccat

SEQ ID NO: 111594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgtgacttccataccacacc

SEQ ID NO: 111595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gtgacttccataccacacct

SEQ ID NO: 111596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccataccacacctgggtcaa

SEQ ID NO: 111597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cataccacacctgggtcaaa

SEQ ID NO: 111598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtcaaattatctattaaga

SEQ ID NO: 111599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctattaagatttatgtatt

SEQ ID NO: 111600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttaagatttatgtattcacg

SEQ ID NO: 111601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agatttatgtattcacgtgg

SEQ ID NO: 111602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgtattcacgtgggcacca

SEQ ID NO: 111603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtattcacgtgggcaccat

SEQ ID NO: 111604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acgtgggcaccatcagatag

SEQ ID NO: 111605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caggtgtcagacagaaagta

SEQ ID NO: 111606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatcatatcttcatccaata

SEQ ID NO: 111607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcatatcttcatccaatat

SEQ ID NO: 111608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catccaatattcatcaaccg

SEQ ID NO: 111609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atccaatattcatcaaccgt

SEQ ID NO: 111610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcaaccgttccagtgagag

SEQ ID NO: 111611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagtgagagacaccatgcta

SEQ ID NO: 111612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggggataattgtttagagaa

SEQ ID NO: 111613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttagagaacattcaattca

SEQ ID NO: 111614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agagaacattcaattcatgc

SEQ ID NO: 111615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagaacattcaattcatgct

SEQ ID NO: 111616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aattcatgctttatgtaaga

SEQ ID NO: 111617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgctttatgtaagaaactc

SEQ ID NO: 111618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatgtaagaaactctaattg

SEQ ID NO: 111619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgtaagaaactctaattga

SEQ ID NO: 111620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtaagaaactctaattgat

SEQ ID NO: 111621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taattgatacttctgaatta

SEQ ID NO: 111622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attgatacttctgaattaag

SEQ ID NO: 111623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atacttctgaattaagcaga

SEQ ID NO: 111624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgaattaagcagacttctg

SEQ ID NO: 111625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaattaagcagacttctga

SEQ ID NO: 111626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aattaagcagacttctgaga

SEQ ID NO: 111627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcagacttctgagagtgca

SEQ ID NO: 111628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgagagtgcatacagatga

SEQ ID NO: 111629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgagagtgcatacagatgat

SEQ ID NO: 111630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agagtgcatacagatgatct

SEQ ID NO: 111631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgtggtacctacagaaata

SEQ ID NO: 111632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagaaataattctactgaac

SEQ ID NO: 111633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tactgaactaaactttgata

SEQ ID NO: 111634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgaactaaactttgatatc

SEQ ID NO: 111635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aactaaactttgatatcttg

SEQ ID NO: 111636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aactttgatatcttgccatc

SEQ ID NO: 111637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgatatcttgccatcagcct

SEQ ID NO: 111638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatatcttgccatcagccta

SEQ ID NO: 111639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atatcttgccatcagcctat

SEQ ID NO: 111640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gccatcagcctatattgaag

SEQ ID NO: 111641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccatcagcctatattgaagg

SEQ ID NO: 111642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tattgaaggaagccattaaa

SEQ ID NO: 111643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaggaagccattaaaaacag

SEQ ID NO: 111644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaacagctatgaaactcgt

SEQ ID NO: 111645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgaaactcgtcattggttac

SEQ ID NO: 111646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gtcattggttacaaagtgga

SEQ ID NO: 111647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gttacaaagtggatgttgat

SEQ ID NO: 111648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaagtggatgttgataaag

SEQ ID NO: 111649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataaagctgagcaaatgatt

SEQ ID NO: 111650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agcaaatgattttgctttgt

SEQ ID NO: 111651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctttgtacaaatctttag

SEQ ID NO: 111652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctttgtacaaatctttagg

SEQ ID NO: 111653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttgtacaaatctttagga

SEQ ID NO: 111654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtacaaatctttaggaata

SEQ ID NO: 111655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtacaaatctttaggaatac

SEQ ID NO: 111656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tacaaatctttaggaatact

SEQ ID NO: 111657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taggaatactatcaagatac

SEQ ID NO: 111658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggaatactatcaagataca

SEQ ID NO: 111659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaatactatcaagatacag

SEQ ID NO: 111660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaagatacagatactatct

SEQ ID NO: 111661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctttatatttgataattaa

SEQ ID NO: 111662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatatttgataattaatatt

SEQ ID NO: 111663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatttgataattaatatta

SEQ ID NO: 111664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatttgataattaatattat

SEQ ID NO: 111665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gataattaatattatcatta

SEQ ID NO: 111666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataattaatattatcattat

SEQ ID NO: 111667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atattatcattatatatgat

SEQ ID NO: 111668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcattatatatgattaatag

SEQ ID NO: 111669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatatgattaatagaacttt

SEQ ID NO: 111670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atagaactttaagatgttat

SEQ ID NO: 111671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taagatgttatagttatgag

SEQ ID NO: 111672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagatgttatagttatgagt

SEQ ID NO: 111673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agatgttatagttatgagta

SEQ ID NO: 111674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagttatgagtacaatctat

SEQ ID NO: 111675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgagtacaatctattaagta

SEQ ID NO: 111676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttaagtataaaaatctatca

SEQ ID NO: 111677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtataaaaatctatcataa

SEQ ID NO: 111678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcataataaatatgtcacat

SEQ ID NO: 111679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatataataaatataagtat

SEQ ID NO: 111680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tataataaaattatataaaa

SEQ ID NO: 111681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tataaaatatataatctatt

SEQ ID NO: 111682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttatattgttaaatgtaatg

SEQ ID NO: 111683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattgttaaatgtaatggtt

SEQ ID NO: 111684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaaatgtaatggttaatgt

SEQ ID NO: 111685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgtaatggttaatgttat

SEQ ID NO: 111686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgttattaattcaaggcta

SEQ ID NO: 111687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaattcaaggctacattta

SEQ ID NO: 111688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attcaaggctacatttattt

SEQ ID NO: 111689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaggctacatttatttctct

SEQ ID NO: 111690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catttatttctctagagaaa

SEQ ID NO: 111691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttctctagagaaaataat

SEQ ID NO: 111692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttctctagagaaaataatt

SEQ ID NO: 111693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctagagaaaataattctt

SEQ ID NO: 111694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctagagaaaataattcttt

SEQ ID NO: 111695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagagaaaataattcttttt

SEQ ID NO: 111696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gagaaaataattctttttta

SEQ ID NO: 111697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttttatgatatagaaatt

SEQ ID NO: 111698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttatgatatagaaattag

SEQ ID NO: 111699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttatgatatagaaattagg

SEQ ID NO: 111700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatgatatagaaattagga

SEQ ID NO: 111701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgatatagaaattaggaa

SEQ ID NO: 111702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgatatagaaattaggaat

SEQ ID NO: 111703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgatatagaaattaggaatt

SEQ ID NO: 111704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaattatggaactatcctg

SEQ ID NO: 111705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggaactatcctgtgttcct

SEQ ID NO: 111706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcctgtgttccttttgccag

SEQ ID NO: 111707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgttccttttgccagtactg

SEQ ID NO: 111708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttttgccagtactgctaga

SEQ ID NO: 111709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgccagtactgctagatag

SEQ ID NO: 111710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgccagtactgctagatagc

SEQ ID NO: 111711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccagtactgctagatagct

SEQ ID NO: 111712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccagtactgctagatagctt

SEQ ID NO: 111713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctagatagcttagaaccagg

SEQ ID NO: 111714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatagcttagaaccaggatg

SEQ ID NO: 111715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaaccaggatgatttatga

SEQ ID NO: 111716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaccaggatgatttatgaa

SEQ ID NO: 111717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgaaaatcatatataacat

SEQ ID NO: 111718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgaaaatcatatataacatg

SEQ ID NO: 111719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acactgtagcagctttctat

SEQ ID NO: 111720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagcagctttctatatattt

SEQ ID NO: 111721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctatatatttgaatagctt

SEQ ID NO: 111722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatatatttgaatagcttt

SEQ ID NO: 111723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatatatttgaatagctttg

SEQ ID NO: 111724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatatttgaatagctttgaa

SEQ ID NO: 111725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaatagctttgaaatgatta

SEQ ID NO: 111726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatagctttgaaatgattaa

SEQ ID NO: 111727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaaatgattaaaatgaaag

SEQ ID NO: 111728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaatgattaaaatgaaagc

SEQ ID NO: 111729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatgattaaaatgaaagca

SEQ ID NO: 111730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgaaagcaacatttcat

SEQ ID NO: 111731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattattaaaagagagcaat

SEQ ID NO: 111732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attattaaaagagagcaatg

SEQ ID NO: 111733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaaagagagcaatgtttt

SEQ ID NO: 111734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagagagcaatgtttttag

SEQ ID NO: 111735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagcattatttcaacctaa

SEQ ID NO: 111736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagcattatttcaacctaat

SEQ ID NO: 111737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcattatttcaacctaata

SEQ ID NO: 111738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcattatttcaacctaataa

SEQ ID NO: 111739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcaacctaataacaaatg

SEQ ID NO: 111740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caacctaataacaaatgcaa

SEQ ID NO: 111741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacctaataacaaatgcaag

SEQ ID NO: 111742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ataacaaatgcaaggacatt

SEQ ID NO: 111743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttacttctaaagtcttcttc

SEQ ID NO: 111744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acttctaaagtcttcttcac

SEQ ID NO: 111745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttctaaagtcttcttcact

SEQ ID NO: 111746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaaagtcttcttcactctc

SEQ ID NO: 111747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaagtcttcttcactctct

SEQ ID NO: 111748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtcttcttcactctctag

SEQ ID NO: 111749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttcactctctagggtattc

SEQ ID NO: 111750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcactctctagggtattca

SEQ ID NO: 111751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cactctctagggtattcatt

SEQ ID NO: 111752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actctctagggtattcatta

SEQ ID NO: 111753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctagggtattcattatgct

SEQ ID NO: 111754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagggtattcattatgcttt

SEQ ID NO: 111755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gggtattcattatgctttct

SEQ ID NO: 111756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attatgctttctaatgtttc

SEQ ID NO: 111757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgctttctaatgtttcatta

SEQ ID NO: 111758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctaatgtttcattattttc

SEQ ID NO: 111759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaatgtttcattattttca

SEQ ID NO: 111760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taatgtttcattattttcaa

SEQ ID NO: 111761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgtttcattattttcaagt

SEQ ID NO: 111762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattattttcaagtgaattt

SEQ ID NO: 111763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attattttcaagtgaatttc

SEQ ID NO: 111764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcaagtgaatttcgaaa

SEQ ID NO: 111765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaagtgaatttcgaaaaca

SEQ ID NO: 111766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caagtgaatttcgaaaacat

SEQ ID NO: 111767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagtgaatttcgaaaacatt

SEQ ID NO: 111768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgaaaacatttatgcttcag

SEQ ID NO: 111769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gaaaacatttatgcttcagg

SEQ ID NO: 111770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgcttcaggtttcccatga

SEQ ID NO: 111771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcttcaggtttcccatgaa

SEQ ID NO: 111772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caggtttcccatgaacagct

SEQ ID NO: 111773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggtttcccatgaacagctg

SEQ ID NO: 111774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccatgaacagctgtagtcc

SEQ ID NO: 111775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccatgaacagctgtagtcca

SEQ ID NO: 111776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagtccaattagtgcaaaca

SEQ ID NO: 111777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgcaaacacactcagacag

SEQ ID NO: 111778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agacagaacacagtcaggat

SEQ ID NO: 111779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttcactgactggatcaaag

SEQ ID NO: 111780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcactgactggatcaaagc

SEQ ID NO: 111781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cactgactggatcaaagccc

SEQ ID NO: 111782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actgactggatcaaagcccc

SEQ ID NO: 111783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actggatcaaagcccctaca

SEQ ID NO: 111784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatcaaagcccctacaattg

SEQ ID NO: 111785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caattgtcttcaggcctgaa

SEQ ID NO: 111786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttcaggcctgaaaatggg

SEQ ID NO: 111787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caggcctgaaaatgggagaa

SEQ ID NO: 111788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggcctgaaaatgggagaaa

SEQ ID NO: 111789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaatgggagaaaaaagtgt

SEQ ID NO: 111790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaatgacataaagcctctg

SEQ ID NO: 111791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatgacataaagcctctga

SEQ ID NO: 111792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgaatcgaaacaaaaaacac

SEQ ID NO: 111793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatcgaaacaaaaaacacaa

SEQ ID NO: 111794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcctagaaagtcatgcatta

SEQ ID NO: 111795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctagaaagtcatgcattat

SEQ ID NO: 111796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctagaaagtcatgcattata

SEQ ID NO: 111797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaagtcatgcattatatca

SEQ ID NO: 111798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatcaaatcaatgaccttaa

SEQ ID NO: 111799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagtaacctaattcaaaaaa

SEQ ID NO: 111800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtaacctaattcaaaaaaa

SEQ ID NO: 111801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attcaaaaaaagccttctgg

SEQ ID NO: 111802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaaaagccttctgggttt

SEQ ID NO: 111803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgggtttgctattttatat

SEQ ID NO: 111804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgggtttgctattttatata

SEQ ID NO: 111805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtttgctattttatatata

SEQ ID NO: 111806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctattttatatatactttg

SEQ ID NO: 111807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctattttatatatactttgt

SEQ ID NO: 111808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttatatatactttgtttt

SEQ ID NO: 111809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatatatactttgtttttat

SEQ ID NO: 111810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatatactttgtttttata

SEQ ID NO: 111811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatatactttgtttttatat

SEQ ID NO: 111812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtttttatatattacagca

SEQ ID NO: 111813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttttatatattacagcaa

SEQ ID NO: 111814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttttatatattacagcaaa

SEQ ID NO: 111815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatatattacagcaaatgg

SEQ ID NO: 111816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatatattacagcaaatggt

SEQ ID NO: 111817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatattacagcaaatggtt

SEQ ID NO: 111818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatattacagcaaatggtta

SEQ ID NO: 111819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagcaaatggttaaaaatag

SEQ ID NO: 111820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaataggaacatattctca

SEQ ID NO: 111821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaaagaatacctaggttgt

SEQ ID NO: 111822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaagaatacctaggttgtca

SEQ ID NO: 111823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggttgtcaaaatgaacaatt

SEQ ID NO: 111824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaaaatgaacaatttggct

SEQ ID NO: 111825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggctattcaaaccactttaa

SEQ ID NO: 111826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctattcaaaccactttaaa

SEQ ID NO: 111827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttcaaaccactttaaaaata

SEQ ID NO: 111828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaccactttaaaaataatt

SEQ ID NO: 111829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaaaataatttttgtaagt

SEQ ID NO: 111830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaataatttttgtaagtt

SEQ ID NO: 111831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaataatttttgtaagttc

SEQ ID NO: 111832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtaagttctaatgtttgt

SEQ ID NO: 111833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaagttctaatgtttgtc

SEQ ID NO: 111834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaagttctaatgtttgtca

SEQ ID NO: 111835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagttctaatgtttgtcaa

SEQ ID NO: 111836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taatgtttgtcaaacaaacc

SEQ ID NO: 111837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgtttgtcaaacaaaccac

SEQ ID NO: 111838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcaaacaaaccacttctct

SEQ ID NO: 111839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaaacaaaccacttctcta

SEQ ID NO: 111840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctctataaatggcaccaaaa

SEQ ID NO: 111841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctataaatggcaccaaaac

SEQ ID NO: 111842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tataaatggcaccaaaacaa

SEQ ID NO: 111843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaatggcaccaaaacaaat

SEQ ID NO: 111844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagcatatagtgacaccttg

SEQ ID NO: 111845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaataattttcaataaaga

SEQ ID NO: 111846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taataattttcaataaagaa

SEQ ID NO: 111847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaataaagaaatggtttgc

SEQ ID NO: 111848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caataaagaaatggtttgct

SEQ ID NO: 111849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aataaagaaatggtttgctg

SEQ ID NO: 111850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctgagaaaaaataaaaaac

SEQ ID NO: 111851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgagaaaaaataaaaaaca

SEQ ID NO: 111852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaaaaaataaaaaacaatg

SEQ ID NO: 111853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atatttatgatctctttcct

SEQ ID NO: 111854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgatctctttcctaagtat

SEQ ID NO: 111855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgatctctttcctaagtatt

SEQ ID NO: 111856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttcctaagtattttaaaat

SEQ ID NO: 111857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcctaagtattttaaaatca

SEQ ID NO: 111858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctaagtattttaaaatcaa

SEQ ID NO: 111859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctaagtattttaaaatcaat

SEQ ID NO: 111860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtattttaaaatcaattaa

SEQ ID NO: 111861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaatcaattaaaatggat

SEQ ID NO: 111862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatcaattaaaatggatt

SEQ ID NO: 111863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatcaattaaaatggattg

SEQ ID NO: 111864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatggattgaaattttcct

SEQ ID NO: 111865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaattttccttcctgtataa

SEQ ID NO: 111866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccttcctgtataagcaaat

SEQ ID NO: 111867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttcctgtataagcaaatg

SEQ ID NO: 111868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttcctgtataagcaaatgg

SEQ ID NO: 111869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctgtataagcaaatggaaa

SEQ ID NO: 111870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgtataagcaaatggaaaa

SEQ ID NO: 111871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tataagcaaatggaaaaaca

SEQ ID NO: 111872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agacaggagggaagatttca

SEQ ID NO: 111873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caagttgagatgtgagccaa

SEQ ID NO: 111874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagttgagatgtgagccaag

SEQ ID NO: 111875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agatgtgagccaagtagtca

SEQ ID NO: 111876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atcctaaagacccatgcaat

SEQ ID NO: 111877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagacccatgcaattgatta

SEQ ID NO: 111878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attaaactcaaaggttgact

SEQ ID NO: 111879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aactcaaaggttgacttttg

SEQ ID NO: 111880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaggttgacttttgataat

SEQ ID NO: 111881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acttttgataatgattgtgg

SEQ ID NO: 111882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgataatgattgtggaaaa

SEQ ID NO: 111883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgataatgattgtggaaaac

SEQ ID NO: 111884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gataatgattgtggaaaaca

SEQ ID NO: 111885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataatgattgtggaaaacag

SEQ ID NO: 111886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggaaaacagaagaaatcaa

SEQ ID NO: 111887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattaaaattgcataaagaa

SEQ ID NO: 111888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attaaaattgcataaagaaa

SEQ ID NO: 111889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattgcataaagaaaggtt

SEQ ID NO: 111890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cataaagaaaggtttttttt

SEQ ID NO: 111891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttatgtctttctttcaa

SEQ ID NO: 111892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttatgtctttctttcaaa

SEQ ID NO: 111893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttatgtctttctttcaaaa

SEQ ID NO: 111894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatgtctttctttcaaaag

SEQ ID NO: 111895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgtctttctttcaaaaga

SEQ ID NO: 111896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgtctttctttcaaaagat

SEQ ID NO: 111897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtctttctttcaaaagatc

SEQ ID NO: 111898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttcaaaagatcaaagtc

SEQ ID NO: 111899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcaaaagatcaaagtca

SEQ ID NO: 111900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcaaaagatcaaagtcag

SEQ ID NO: 111901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaaaagatcaaagtcagcc

SEQ ID NO: 111902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaagatcaaagtcagccc

SEQ ID NO: 111903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaagatcaaagtcagccct

SEQ ID NO: 111904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtgtttaaccccactctcac

SEQ ID NO: 111905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaccccactctcacctggaa

SEQ ID NO: 111906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
accccactctcacctggaat

SEQ ID NO: 111907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcacctggaatgactgaaat

SEQ ID NO: 111908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acctggaatgactgaaattg

SEQ ID NO: 111909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaatgactgaaattgttttc

SEQ ID NO: 111910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaattgttttcaatgctcgg

SEQ ID NO: 111911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttcaatgctcggagaact

SEQ ID NO: 111912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaatgctcggagaactctg

SEQ ID NO: 111913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatgctcggagaactctga

SEQ ID NO: 111914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgctcggagaactctgaa

SEQ ID NO: 111915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggagaactctgaatgttctc

SEQ ID NO: 111916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgaatgttctcaatgctgag

SEQ ID NO: 111917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatgttctcaatgctgagac

SEQ ID NO: 111918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaatgctgagacattgccc

SEQ ID NO: 111919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatgctgagacattgcccag

SEQ ID NO: 111920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agacattgcccaggtccaca

SEQ ID NO: 111921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccaggtccacaaactctgt

SEQ ID NO: 111922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtcacatatctgtaatagg

SEQ ID NO: 111923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcacatatctgtaatagggg

SEQ ID NO: 111924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taataggggagtttatacac

SEQ ID NO: 111925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atacacacagtgacgacaca

SEQ ID NO: 111926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacacacagtgacgacacac

SEQ ID NO: 111927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaaatagttggagttatga

SEQ ID NO: 111928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagttatgagtggcctaatg

SEQ ID NO: 111929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgagtggcctaatgcttcac

SEQ ID NO: 111930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgcttcacaccaattactt

SEQ ID NO: 111931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacaccaattacttcttacc

SEQ ID NO: 111932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaccaattacttcttacct

SEQ ID NO: 111933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttcttacctgggattacag

SEQ ID NO: 111934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttacctgggattacagaaa

SEQ ID NO: 111935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttacctgggattacagaaat

SEQ ID NO: 111936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acctgggattacagaaatag

SEQ ID NO: 111937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctgggattacagaaatagt

SEQ ID NO: 111938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggattacagaaatagttttc

SEQ ID NO: 111939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagaaatagttttcaaagct

SEQ ID NO: 111940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaagctctcaatactctg

SEQ ID NO: 111941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaagctctcaatactctga

SEQ ID NO: 111942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaagctctcaatactctgaa

SEQ ID NO: 111943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaatactctgaaagttcga

SEQ ID NO: 111944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatactctgaaagttcgaag

SEQ ID NO: 111945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgaaagttcgaagagctgaa

SEQ ID NO: 111946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaagttcgaagagctgaaac

SEQ ID NO: 111947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gaagagctgaaacattgcct

SEQ ID NO: 111948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaacattgcctaggtttaca

SEQ ID NO: 111949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctaggtttacaaattctgt

SEQ ID NO: 111950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtttacaaattctgttaaa

SEQ ID NO: 111951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaaattctgttaaatacct

SEQ ID NO: 111952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaattctgttaaatacctg

SEQ ID NO: 111953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttaaatacctgtagaatt

SEQ ID NO: 111954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttaaatacctgtagaattaa

SEQ ID NO: 111955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatacctgtagaattaaatc

SEQ ID NO: 111956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagaattaaatcagaattat

SEQ ID NO: 111957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatcagaattattcagaatt

SEQ ID NO: 111958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcagaatttagatagagtc

SEQ ID NO: 111959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaatttagatagagtctat

SEQ ID NO: 111960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agatagagtctatgatactt

SEQ ID NO: 111961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatagagtctatgatactta

SEQ ID NO: 111962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgatacttacctgagccttt

SEQ ID NO: 111963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acctgagcctttagtcaagg

SEQ ID NO: 111964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctgagcctttagtcaaggt

SEQ ID NO: 111965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agcctttagtcaaggtattt

SEQ ID NO: 111966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagtcaaggtattttctacg

SEQ ID NO: 111967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtcaaggtattttctacgt

SEQ ID NO: 111968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtcaaggtattttctacgtt

SEQ ID NO: 111969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctacgtttggggcttctat

SEQ ID NO: 111970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctacgtttggggcttctatt

SEQ ID NO: 111971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacgtttggggcttctattt

SEQ ID NO: 111972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cgtttggggcttctatttta

SEQ ID NO: 111973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggggcttctattttaaatgt

SEQ ID NO: 111974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggcttctattttaaatgta

SEQ ID NO: 111975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctattttaaatgtatagttc

SEQ ID NO: 111976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattttaaatgtatagttct

SEQ ID NO: 111977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttaaatgtatagttctgc

SEQ ID NO: 111978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaatgtatagttctgcaag

SEQ ID NO: 111979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatgtatagttctgcaagt

SEQ ID NO: 111980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgtatagttctgcaagtc

SEQ ID NO: 111981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcaagtcttttttgctatc

SEQ ID NO: 111982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caagtcttttttgctatcat

SEQ ID NO: 111983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttgctatcataactaact

SEQ ID NO: 111984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgctatcataactaactt

SEQ ID NO: 111985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgctatcataactaactta

SEQ ID NO: 111986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctatcataactaacttaa

SEQ ID NO: 111987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctatcataactaacttaat

SEQ ID NO: 111988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctatcataactaacttaatt

SEQ ID NO: 111989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcataactaacttaatttaa

SEQ ID NO: 111990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acttaatttaattagcattg

SEQ ID NO: 111991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatttaattagcattgattt

SEQ ID NO: 111992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttaattagcattgatttg

SEQ ID NO: 111993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattagcattgatttgactc

SEQ ID NO: 111994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attagcattgatttgactca

SEQ ID NO: 111995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcattgatttgactcatttg

SEQ ID NO: 111996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atttgactcatttgatgcaa

SEQ ID NO: 111997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gactcatttgatgcaaacaa

SEQ ID NO: 111998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actcatttgatgcaaacaaa

SEQ ID NO: 111999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atttgatgcaaacaaaatac

SEQ ID NO: 112000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatgcaaacaaaatacagat

SEQ ID NO: 112001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgcaaacaaaatacagata

SEQ ID NO: 112002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatattattaaattggattc

SEQ ID NO: 112003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaattggattcatacact

SEQ ID NO: 112004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattggattcatacacttaa

SEQ ID NO: 112005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gattcatacacttaaatgcg

SEQ ID NO: 112006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atacacttaaatgcgtaaac

SEQ ID NO: 112007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaatgcgtaaacaactaaat

SEQ ID NO: 112008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgcgtaaacaactaaatg

SEQ ID NO: 112009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatgtttcaattgttggacc

SEQ ID NO: 112010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caattgttggacccttaaca

SEQ ID NO: 112011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aattgttggacccttaacat

SEQ ID NO: 112012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttggacccttaacattatgg

SEQ ID NO: 112013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gacccttaacattatggtaa

SEQ ID NO: 112014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacattatggtaatttagac

SEQ ID NO: 112015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acattatggtaatttagact

SEQ ID NO: 112016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggtaatttagacttttaat

SEQ ID NO: 112017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agacttttaattttttataa

SEQ ID NO: 112018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gacttttaattttttataaa

SEQ ID NO: 112019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaattttttataaaacatt

SEQ ID NO: 112020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattttttataaaacattg

SEQ ID NO: 112021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattttttataaaacattga

SEQ ID NO: 112022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttttataaaacattgaa

SEQ ID NO: 112023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttataaaacattgaaaata

SEQ ID NO: 112024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttataaaacattgaaaatag

SEQ ID NO: 112025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tataaaacattgaaaatagt

SEQ ID NO: 112026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataaaacattgaaaatagta

SEQ ID NO: 112027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaaacattgaaaatagtat

SEQ ID NO: 112028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaatagtatgctaagtgtc

SEQ ID NO: 112029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtgtcagacacaaaaggct

SEQ ID NO: 112030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catactgtttgatatttcca

SEQ ID NO: 112031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttgatatttccattcataa

SEQ ID NO: 112032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatatttccattcataaaaa

SEQ ID NO: 112033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atatttccattcataaaaaa

SEQ ID NO: 112034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccattcataaaaaaatccaa

SEQ ID NO: 112035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattcataaaaaaatccaaa

SEQ ID NO: 112036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataaaaaaatccaaatagac

SEQ ID NO: 112037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaaggggccagggagagaa

SEQ ID NO: 112038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaggggccagggagagaag

SEQ ID NO: 112039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagtgactgctaatgagtac

SEQ ID NO: 112040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctaatgagtacagagtttct

SEQ ID NO: 112041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgagtacagagtttctatt

SEQ ID NO: 112042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatttggggttgttaaact

SEQ ID NO: 112043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatttggggttgttaaactt

SEQ ID NO: 112044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttggggttgttaaacttct

SEQ ID NO: 112045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggggttgttaaacttctcta

SEQ ID NO: 112046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggttgttaaacttctctaa

SEQ ID NO: 112047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaaacttctctaattaggt

SEQ ID NO: 112048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacttctctaattaggtagt

SEQ ID NO: 112049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctctaattaggtagtggtga

SEQ ID NO: 112050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctaattaggtagtggtgat

SEQ ID NO: 112051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taattaggtagtggtgatgt

SEQ ID NO: 112052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attaggtagtggtgatgttg

SEQ ID NO: 112053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtagtggtgatgttgcgca

SEQ ID NO: 112054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cgcaagtttgtcaatatact

SEQ ID NO: 112055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcaatatactgaaaaacac

SEQ ID NO: 112056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaatatactgaaaaacact

SEQ ID NO: 112057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaaacactgaattgtatac

SEQ ID NO: 112058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aattgtatactttaaaattg

SEQ ID NO: 112059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatactttaaaattgtgaat

SEQ ID NO: 112060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaaattgtgaattttgtag

SEQ ID NO: 112061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaattgtgaattttgtagt

SEQ ID NO: 112062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattgtgaattttgtagta

SEQ ID NO: 112063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaattttgtagtatttgaa

SEQ ID NO: 112064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtagtatttgaattgtacc

SEQ ID NO: 112065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtagtatttgaattgtacca

SEQ ID NO: 112066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagtatttgaattgtaccaa

SEQ ID NO: 112067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaattgtaccaataggaaaa

SEQ ID NO: 112068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattgtaccaataggaaaaa

SEQ ID NO: 112069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taccaataggaaaaaaagga

SEQ ID NO: 112070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgagaagaggcagtcttctt

SEQ ID NO: 112071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttgcacaatgttttctta

SEQ ID NO: 112072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttgcacaatgttttcttag

SEQ ID NO: 112073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcacaatgttttcttagca

SEQ ID NO: 112074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcacaatgttttcttagcag

SEQ ID NO: 112075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cacaatgttttcttagcagc

SEQ ID NO: 112076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttagcagcaggtagcaga

SEQ ID NO: 112077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttagcagcaggtagcagat

SEQ ID NO: 112078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttagcagcaggtagcagatg

SEQ ID NO: 112079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agcagcaggtagcagatgga

SEQ ID NO: 112080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcagcaggtagcagatggaa

SEQ ID NO: 112081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccccatcatatgtgacctca

SEQ ID NO: 112082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaaggagggagcctgatgg

SEQ ID NO: 112083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atggaaaagaggttaggcag

SEQ ID NO: 112084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggcagggatgaaggaatcgg

SEQ ID NO: 112085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaatcttaagacccttctg

SEQ ID NO: 112086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagacccttctgtattgtct

SEQ ID NO: 112087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agacccttctgtattgtcta

SEQ ID NO: 112088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgtattgtctaggtggctc

SEQ ID NO: 112089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtattgtctaggtggctcc

SEQ ID NO: 112090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tattgtctaggtggctccag

SEQ ID NO: 112091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctaggtggctccagtgaac

SEQ ID NO: 112092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtggctccagtgaacctgg

SEQ ID NO: 112093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagtgaacctggattacttt

SEQ ID NO: 112094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gattactttgataattcaaa

SEQ ID NO: 112095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttgataattcaaagtcat

SEQ ID NO: 112096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgataattcaaagtcattaa

SEQ ID NO: 112097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gataattcaaagtcattaac

SEQ ID NO: 112098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataattcaaagtcattaacg

SEQ ID NO: 112099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaagtcattaacggaaaata

SEQ ID NO: 112100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acggaaaatagaatatctag

SEQ ID NO: 112101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatatgagattgtaaaaatc

SEQ ID NO: 112102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaaaatccatttttctgat

SEQ ID NO: 112103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctgataaatacatttggg

SEQ ID NO: 112104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgataaatacatttggga

SEQ ID NO: 112105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgataaatacatttgggaa

SEQ ID NO: 112106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgataaatacatttgggaaa

SEQ ID NO: 112107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ataaatacatttgggaaaag

SEQ ID NO: 112108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggaaaagagtaacaattat

SEQ ID NO: 112109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaaaagagtaacaattatg

SEQ ID NO: 112110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgaataaattaaaattatac

SEQ ID NO: 112111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattatactgtaatgtaat

SEQ ID NO: 112112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactgtaatgtaatattttc

SEQ ID NO: 112113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taatgtaatattttccttga

SEQ ID NO: 112114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccttgaaaataaactgagt

SEQ ID NO: 112115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttgaaaataaactgagtg

SEQ ID NO: 112116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttgaaaataaactgagtgt

SEQ ID NO: 112117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaaataaactgagtgtata

SEQ ID NO: 112118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaataaactgagtgtatat

SEQ ID NO: 112119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtgtatatataatgtgtat

SEQ ID NO: 112120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcttaggcttagtaagcag

SEQ ID NO: 112121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aggcttagtaagcagtgaca

SEQ ID NO: 112122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggcttagtaagcagtgacag

SEQ ID NO: 112123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtaagcagtgacagctctt

SEQ ID NO: 112124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtaagcagtgacagctcttt

SEQ ID NO: 112125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttacaaatatatactttt

SEQ ID NO: 112126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttacaaatatatacttttat

SEQ ID NO: 112127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacaaatatatacttttata

SEQ ID NO: 112128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaaatatatacttttatat

SEQ ID NO: 112129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaatatatacttttatatt

SEQ ID NO: 112130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatattttaatacaaaaat

SEQ ID NO: 112131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatattttaatacaaaaata

SEQ ID NO: 112132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atattttaatacaaaaatat

SEQ ID NO: 112133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattttaatacaaaaatata

SEQ ID NO: 112134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatacaaaaatataaaata

SEQ ID NO: 112135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatacaaaaatataaaataa

SEQ ID NO: 112136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atacaaaaatataaaataat

SEQ ID NO: 112137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aataatacagggtaatataa

SEQ ID NO: 112138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tacttgtatttaaaggcctg

SEQ ID NO: 112139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtatttaaaggcctgagttt

SEQ ID NO: 112140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatttaaaggcctgagtttt

SEQ ID NO: 112141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaggcctgagttttttgtg

SEQ ID NO: 112142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaggcctgagttttttgtgt

SEQ ID NO: 112143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agttttttgtgtgcttctta

SEQ ID NO: 112144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgtgtgcttcttataggt

SEQ ID NO: 112145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtgtgcttcttataggtt

SEQ ID NO: 112146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgtgcttcttataggttt

SEQ ID NO: 112147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgtgcttcttataggtttt

SEQ ID NO: 112148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtgcttcttataggtttta

SEQ ID NO: 112149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttataggttttattcattt

SEQ ID NO: 112150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttataggttttattcatttt

SEQ ID NO: 112151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataggttttattcattttta

SEQ ID NO: 112152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taggttttattcatttttaa

SEQ ID NO: 112153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattcatttttaaacaagaa

SEQ ID NO: 112154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attcatttttaaacaagaac

SEQ ID NO: 112155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcatttttaaacaagaact

SEQ ID NO: 112156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttttaaacaagaacttgg

SEQ ID NO: 112157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaacaagaacttggaaaa

SEQ ID NO: 112158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaacaagaacttggaaaaa

SEQ ID NO: 112159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaacaagaacttggaaaaag

SEQ ID NO: 112160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacaagaacttggaaaaagt

SEQ ID NO: 112161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaaaaagtgtaaacctaat

SEQ ID NO: 112162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaaaagtgtaaacctaatt

SEQ ID NO: 112163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attggcactgcatagactat

SEQ ID NO: 112164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcactgcatagactatccat

SEQ ID NO: 112165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catagactatccatccaagt

SEQ ID NO: 112166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tccatccaagtgctgagcat

SEQ ID NO: 112167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agcatggaggaagatgatca

SEQ ID NO: 112168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatgatgtcacatacctctg

SEQ ID NO: 112169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgagtgggagatagtctttt

SEQ ID NO: 112170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtgggagatagtctttttg

SEQ ID NO: 112171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttgaaaaatttagtatttg

SEQ ID NO: 112172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgaaaaatttagtatttgc

SEQ ID NO: 112173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaaaaatttagtatttgcc

SEQ ID NO: 112174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaaatttagtatttgcct

SEQ ID NO: 112175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaatttagtatttgccta

SEQ ID NO: 112176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtatttgcctatcaatgac

SEQ ID NO: 112177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtatttgcctatcaatgact

SEQ ID NO: 112178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcctatcaatgactagcttt

SEQ ID NO: 112179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctatcaatgactagctttc

SEQ ID NO: 112180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaatgactagctttcatat

SEQ ID NO: 112181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctttcatatagcttccatt

SEQ ID NO: 112182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcatatagcttccattttcc

SEQ ID NO: 112183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catatagcttccattttcct

SEQ ID NO: 112184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatagcttccattttcctt

SEQ ID NO: 112185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccattttcctttaaatacag

SEQ ID NO: 112186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattttcctttaaatacaga

SEQ ID NO: 112187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctttaaatacagacattc

SEQ ID NO: 112188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctttaaatacagacattcc

SEQ ID NO: 112189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttaaatacagacattcca

SEQ ID NO: 112190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaatacagacattccatgc

SEQ ID NO: 112191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatacagacattccatgct

SEQ ID NO: 112192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatacagacattccatgctg

SEQ ID NO: 112193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catgctggaaaaatcagacc

SEQ ID NO: 112194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaaaatcagaccccagagg

SEQ ID NO: 112195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctgttattggaacactgtg

SEQ ID NO: 112196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgttattggaacactgtgc

SEQ ID NO: 112197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttattggaacactgtgctgc

SEQ ID NO: 112198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttggaacactgtgctgcctg

SEQ ID NO: 112199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaacactgtgctgcctgaga

SEQ ID NO: 112200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgctgcctgagattttcata

SEQ ID NO: 112201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctgagattttcataaattt

SEQ ID NO: 112202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agattttcataaatttgccg

SEQ ID NO: 112203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcataaatttgccgtttcaa

SEQ ID NO: 112204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cataaatttgccgtttcaaa

SEQ ID NO: 112205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataaatttgccgtttcaaaa

SEQ ID NO: 112206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccgtttcaaaaagctgaaa

SEQ ID NO: 112207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccgtttcaaaaagctgaaag

SEQ ID NO: 112208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaaagctgaaagtactta

SEQ ID NO: 112209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaagctgaaagtacttac

SEQ ID NO: 112210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaagtacttacgcaaaaaca

SEQ ID NO: 112211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acgcaaaaacaatgacgaca

SEQ ID NO: 112212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cgcaaaaacaatgacgacaa

SEQ ID NO: 112213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacgggtcacgaagaaaagt

SEQ ID NO: 112214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctacacagaagcctcttg

SEQ ID NO: 112215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctacacagaagcctcttgca

SEQ ID NO: 112216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacagaagcctcttgcaagg

SEQ ID NO: 112217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgcaaggatttttacaagt

SEQ ID NO: 112218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcaaggatttttacaagtga

SEQ ID NO: 112219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaggatttttacaagtgat

SEQ ID NO: 112220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttacaagtgattcaaaagta

SEQ ID NO: 112221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacaagtgattcaaaagtat

SEQ ID NO: 112222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaagtgattcaaaagtata

SEQ ID NO: 112223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caagtgattcaaaagtatat

SEQ ID NO: 112224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaagtatatattccagtaa

SEQ ID NO: 112225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagtaaaagtgtacctaaac

SEQ ID NO: 112226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacacaagattccattggga

SEQ ID NO: 112227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattgggatactagatgtga

SEQ ID NO: 112228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggatactagatgtgaaaaga

SEQ ID NO: 112229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatgtgaaaagaatacaacc

SEQ ID NO: 112230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tataacttattttctctaat

SEQ ID NO: 112231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataacttattttctctaatt

SEQ ID NO: 112232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taacttattttctctaatta

SEQ ID NO: 112233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attttctctaattaaccact

SEQ ID NO: 112234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttctctaattaaccactg

SEQ ID NO: 112235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctctaattaaccactggaa

SEQ ID NO: 112236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctaattaaccactggaag

SEQ ID NO: 112237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctaattaaccactggaaga

SEQ ID NO: 112238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taattaaccactggaagaca

SEQ ID NO: 112239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attaaccactggaagacata

SEQ ID NO: 112240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
accactggaagacatatatt

SEQ ID NO: 112241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaagacatatattggaggat

SEQ ID NO: 112242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaggatggctgttgggttat

SEQ ID NO: 112243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgggttatggacacaccct

SEQ ID NO: 112244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggttatggacacaccctatt

SEQ ID NO: 112245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggacacaccctattaaact

SEQ ID NO: 112246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttaaactacaataggtctat

SEQ ID NO: 112247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aactacaataggtctatcca

SEQ ID NO: 112248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caataggtctatccagaaaa

SEQ ID NO: 112249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tccagaaaatattaaaatgt

SEQ ID NO: 112250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgtcaatatcagaaaca

SEQ ID NO: 112251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccagaaagcagaggtacttg

SEQ ID NO: 112252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaataactaagaatatagg

SEQ ID NO: 112253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaataactaagaatataggt

SEQ ID NO: 112254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaatataggtctcagatct

SEQ ID NO: 112255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agatctgcctaaaaatttcc

SEQ ID NO: 112256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctaaaaatttcctacattg

SEQ ID NO: 112257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaatttcctacattgcttc

SEQ ID NO: 112258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctacattgcttctatcaaa

SEQ ID NO: 112259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctacattgcttctatcaaaa

SEQ ID NO: 112260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cattgcttctatcaaaaatt

SEQ ID NO: 112261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttctatcaaaaattcaccc

SEQ ID NO: 112262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctatcaaaaattcacccaat

SEQ ID NO: 112263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatcaaaaattcacccaatc

SEQ ID NO: 112264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaaaaattcacccaatcat

SEQ ID NO: 112265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acccaatcatttaaaaatac

SEQ ID NO: 112266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaatacacccatataatt

SEQ ID NO: 112267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatacacccatataatta

SEQ ID NO: 112268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaaacatacacccaagaat

SEQ ID NO: 112269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaacaggatggagcatctg

SEQ ID NO: 112270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acaagttcattctttgagaa

SEQ ID NO: 112271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attctttgagaaaacactgt

SEQ ID NO: 112272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttgagaaaacactgtagca

SEQ ID NO: 112273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgagaaaacactgtagcatc

SEQ ID NO: 112274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagaaaacactgtagcatct

SEQ ID NO: 112275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaaaacactgtagcatcta

SEQ ID NO: 112276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagcatctaatttttctaat

SEQ ID NO: 112277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttttctaatctagcaggt

SEQ ID NO: 112278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctaatctagcaggttaat

SEQ ID NO: 112279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctaatctagcaggttaata

SEQ ID NO: 112280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaatctagcaggttaatat

SEQ ID NO: 112281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taatctagcaggttaatatc

SEQ ID NO: 112282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atctagcaggttaatatcat

SEQ ID NO: 112283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcaggttaatatcatagagg

SEQ ID NO: 112284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatcatagaggaggtaaag

SEQ ID NO: 112285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccatcttcataaatgcagt

SEQ ID NO: 112286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cataaatgcagtaacttcct

SEQ ID NO: 112287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataaatgcagtaacttcctg

SEQ ID NO: 112288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctggcaggaaaaggaaagg

SEQ ID NO: 112289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctggcaggaaaaggaaagga

SEQ ID NO: 112290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcaggaaaaggaaaggatga

SEQ ID NO: 112291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tattaaaatgtacttatacc

SEQ ID NO: 112292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgtacttatacccactt

SEQ ID NO: 112293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atacccacttactcgacatt

SEQ ID NO: 112294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacccacttactcgacattt

SEQ ID NO: 112295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actcgacatttttggtccag

SEQ ID NO: 112296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcgacatttttggtccagt

SEQ ID NO: 112297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gacatttttggtccagtccg

SEQ ID NO: 112298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttggtccagtccggtgggtt

SEQ ID NO: 112299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggtccagtccggtgggtta

SEQ ID NO: 112300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtccagtccggtgggttat

SEQ ID NO: 112301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtccagtccggtgggttatt

SEQ ID NO: 112302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcatggtcataaatatgca

SEQ ID NO: 112303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atggtcataaatatgcagtt

SEQ ID NO: 112304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcagaatagtgcacatgat

SEQ ID NO: 112305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcagaatagtgcacatgatg

SEQ ID NO: 112306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aataaggtagcttagaatca

SEQ ID NO: 112307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaatcaaggaacaaaagag

SEQ ID NO: 112308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatcaaggaacaaaagaga

SEQ ID NO: 112309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaatatttgaggatgacac

SEQ ID NO: 112310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatatttgaggatgacact

SEQ ID NO: 112311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaggatgacacttgttgaaa

SEQ ID NO: 112312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggatgacacttgttgaaat

SEQ ID NO: 112313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttgaaatgcttacaacttt

SEQ ID NO: 112314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgaaatgcttacaactttt

SEQ ID NO: 112315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatgcttacaacttttcct

SEQ ID NO: 112316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acaacttttcctaagaaaaa

SEQ ID NO: 112317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caacttttcctaagaaaaaa

SEQ ID NO: 112318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcctaagaaaaaaattcta

SEQ ID NO: 112319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctaagaaaaaaattctaa

SEQ ID NO: 112320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctaagaaaaaaattctaaa

SEQ ID NO: 112321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctaagaaaaaaattctaaat

SEQ ID NO: 112322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaaaaaaattctaaatgag

SEQ ID NO: 112323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaatgagcttgtagactat

SEQ ID NO: 112324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatgagcttgtagactattt

SEQ ID NO: 112325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtagactattttgtctcttt

SEQ ID NO: 112326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagactattttgtctctttg

SEQ ID NO: 112327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttgtctctttgaacaaga

SEQ ID NO: 112328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtctctttgaacaagagag

SEQ ID NO: 112329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtctctttgaacaagagagt

SEQ ID NO: 112330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctctttgaacaagagagta

SEQ ID NO: 112331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttgaacaagagagtaataa

SEQ ID NO: 112332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaacaagagagtaataaat

SEQ ID NO: 112333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaacaagagagtaataaata

SEQ ID NO: 112334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacaagagagtaataaataa

SEQ ID NO: 112335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatcttaatattgccactc

SEQ ID NO: 112336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatattgccactctcccagt

SEQ ID NO: 112337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atattgccactctcccagtc

SEQ ID NO: 112338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccactctcccagtcttctct

SEQ ID NO: 112339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcccagtcttctctgagacc

SEQ ID NO: 112340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccagtcttctctgagaccca

SEQ ID NO: 112341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctctgagacccatgacaaat

SEQ ID NO: 112342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgagacccatgacaaatt

SEQ ID NO: 112343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgagacccatgacaaattat

SEQ ID NO: 112344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agacccatgacaaattatat

SEQ ID NO: 112345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattaataatactgaaatta

SEQ ID NO: 112346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataatactgaaattaataaa

SEQ ID NO: 112347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaattaataaactaaaacca

SEQ ID NO: 112348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataaactaaaaccagagtct

SEQ ID NO: 112349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaccagagtctttcaaggt

SEQ ID NO: 112350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaaggtgcaaaaggtataa

SEQ ID NO: 112351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaggtgcaaaaggtataac

SEQ ID NO: 112352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaggtgcaaaaggtataaca

SEQ ID NO: 112353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatttgaataaaatagcaaa

SEQ ID NO: 112354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaataaaatagcaaaaatta

SEQ ID NO: 112355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aataaaatagcaaaaattac

SEQ ID NO: 112356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caccataaagtgccactgga

SEQ ID NO: 112357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatgtaatcatttttaaaag

SEQ ID NO: 112358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaaggatatgagtgtac

SEQ ID NO: 112359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaggatatgagtgtact

SEQ ID NO: 112360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaggatatgagtgtacta

SEQ ID NO: 112361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaggatatgagtgtactaa

SEQ ID NO: 112362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatcttaatagatattctt

SEQ ID NO: 112363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatagatattcttcttagag

SEQ ID NO: 112364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atagatattcttcttagagg

SEQ ID NO: 112365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcttagaggactgaaagga

SEQ ID NO: 112366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttagaggactgaaaggaga

SEQ ID NO: 112367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttagaggactgaaaggagaa

SEQ ID NO: 112368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaggactgaaaggagaaag

SEQ ID NO: 112369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaggactgaaaggagaaagc

SEQ ID NO: 112370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaggagaaagcatatataa

SEQ ID NO: 112371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaacggaagattgttttccc

SEQ ID NO: 112372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttccctttgttcaatact

SEQ ID NO: 112373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccctttgttcaatactatg

SEQ ID NO: 112374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctttgttcaatactatga

SEQ ID NO: 112375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctttgttcaatactatgaa

SEQ ID NO: 112376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgttcaatactatgaaagtc

SEQ ID NO: 112377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttcaatactatgaaagtct

SEQ ID NO: 112378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttcaatactatgaaagtctg

SEQ ID NO: 112379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatactatgaaagtctgcag

SEQ ID NO: 112380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgaaagtctgcaggaggaaa

SEQ ID NO: 112381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caggaggaaaaagaaaggat

SEQ ID NO: 112382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaatccaaaatatcaattt

SEQ ID NO: 112383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcacatcaatatcagcagt

SEQ ID NO: 112384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcacatcaatatcagcagtt

SEQ ID NO: 112385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacatcaatatcagcagttt

SEQ ID NO: 112386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acatcaatatcagcagttta

SEQ ID NO: 112387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acctttctacatggcagtgt

SEQ ID NO: 112388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctttctacatggcagtgtt

SEQ ID NO: 112389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctacatggcagtgttatat

SEQ ID NO: 112390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctacatggcagtgttatatt

SEQ ID NO: 112391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacatggcagtgttatattg

SEQ ID NO: 112392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catggcagtgttatattgaa

SEQ ID NO: 112393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattgaagaaacactgccat

SEQ ID NO: 112394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagaaacactgccatcagac

SEQ ID NO: 112395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccatcagactccagcaatgt

SEQ ID NO: 112396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagcaatgtggttccaatgt

SEQ ID NO: 112397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caatgtcatcaacgcatcta

SEQ ID NO: 112398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaatgtcaccttggccaat

SEQ ID NO: 112399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggccaatgaactccaagtcc

SEQ ID NO: 112400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gccaatgaactccaagtcca

SEQ ID NO: 112401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caagtccacttcttcatagt

SEQ ID NO: 112402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttcatagtaactttaaaaa

SEQ ID NO: 112403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcatagtaactttaaaaat

SEQ ID NO: 112404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catagtaactttaaaaattg

SEQ ID NO: 112405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atagtaactttaaaaattga

SEQ ID NO: 112406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaaaattgagctatttgtt

SEQ ID NO: 112407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaattgagctatttgtta

SEQ ID NO: 112408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaattgagctatttgttag

SEQ ID NO: 112409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agctatttgttagcatgtat

SEQ ID NO: 112410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttgttagcatgtattgctt

SEQ ID NO: 112411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttagcatgtattgcttaga

SEQ ID NO: 112412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttagcatgtattgcttagag

SEQ ID NO: 112413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcatgtattgcttagagctt

SEQ ID NO: 112414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttagagctttcaaaatact

SEQ ID NO: 112415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agagctttcaaaatactgta

SEQ ID NO: 112416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagctttcaaaatactgtat

SEQ ID NO: 112417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaaaatactgtatttcata

SEQ ID NO: 112418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaatactgtatttcatat

SEQ ID NO: 112419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaatactgtatttcatatt

SEQ ID NO: 112420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatttcatatttttcatttt

SEQ ID NO: 112421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catatttttcattttctttc

SEQ ID NO: 112422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatttttcattttctttca

SEQ ID NO: 112423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcattttctttcaccagta

SEQ ID NO: 112424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattttctttcaccagtaa

SEQ ID NO: 112425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattttctttcaccagtaac

SEQ ID NO: 112426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attttctttcaccagtaaca

SEQ ID NO: 112427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttcaccagtaacaataa

SEQ ID NO: 112428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcaccagtaacaataac

SEQ ID NO: 112429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcaccagtaacaataact

SEQ ID NO: 112430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaccagtaacaataactgt

SEQ ID NO: 112431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caccagtaacaataactgtg

SEQ ID NO: 112432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accagtaacaataactgtgg

SEQ ID NO: 112433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggttaagttattttaaagt

SEQ ID NO: 112434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agttattttaaagtacaact

SEQ ID NO: 112435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaaagtacaacttcttt

SEQ ID NO: 112436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaagtacaacttctttccc

SEQ ID NO: 112437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagtacaacttctttccct

SEQ ID NO: 112438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtacaacttctttccctt

SEQ ID NO: 112439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttcccttccattacactg

SEQ ID NO: 112440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcccttccattacactgc

SEQ ID NO: 112441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcccttccattacactgcat

SEQ ID NO: 112442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccttccattacactgcatt

SEQ ID NO: 112443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttccattacactgcattt

SEQ ID NO: 112444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccattacactgcattttaag

SEQ ID NO: 112445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattacactgcattttaaga

SEQ ID NO: 112446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cactgcattttaagaaagcc

SEQ ID NO: 112447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cattttaagaaagccaaata

SEQ ID NO: 112448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagaaagccaaatagaaac

SEQ ID NO: 112449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagaaagccaaatagaaact

SEQ ID NO: 112450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaaagccaaatagaaacta

SEQ ID NO: 112451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctatctctaatatttttat

SEQ ID NO: 112452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctctaatatttttatcata

SEQ ID NO: 112453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taatatttttatcataaaac

SEQ ID NO: 112454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atatttttatcataaaacct

SEQ ID NO: 112455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatcataaaaccttgagaa

SEQ ID NO: 112456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcataaaaccttgagaat

SEQ ID NO: 112457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcataaaaccttgagaatt

SEQ ID NO: 112458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcataaaaccttgagaattt

SEQ ID NO: 112459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagaattttaatacttgctg

SEQ ID NO: 112460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaattttaatacttgctgg

SEQ ID NO: 112461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatacttgctggcaattgt

SEQ ID NO: 112462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatacttgctggcaattgtt

SEQ ID NO: 112463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atacttgctggcaattgtta

SEQ ID NO: 112464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctggcaattgttatggtta

SEQ ID NO: 112465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctggcaattgttatggttag

SEQ ID NO: 112466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcaattgttatggttagcag

SEQ ID NO: 112467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttatggttagcagcacatgt

SEQ ID NO: 112468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggttagcagcacatgttcc

SEQ ID NO: 112469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcagcacatgttccaaaata

SEQ ID NO: 112470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaaatatgagttatttcaa

SEQ ID NO: 112471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcaaaaaatattttccta

SEQ ID NO: 112472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaaaatattttcctaagt

SEQ ID NO: 112473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaaatattttcctaagtt

SEQ ID NO: 112474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctaagttgaaggaacgtc

SEQ ID NO: 112475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctaagttgaaggaacgtca

SEQ ID NO: 112476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctaagttgaaggaacgtcag

SEQ ID NO: 112477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agttgaaggaacgtcagagt

SEQ ID NO: 112478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaggaacgtcagagttggaa

SEQ ID NO: 112479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaagaatccttccaatcact

SEQ ID NO: 112480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaatcactgagttcaattt

SEQ ID NO: 112481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caatcactgagttcaatttc

SEQ ID NO: 112482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agttcaatttctttatttta

SEQ ID NO: 112483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatttctttattttagttat

SEQ ID NO: 112484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttattttagttataatac

SEQ ID NO: 112485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttattttagttataatact

SEQ ID NO: 112486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattttagttataatactaa

SEQ ID NO: 112487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttagttataatactaat

SEQ ID NO: 112488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttagttataatactaata

SEQ ID NO: 112489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagttataatactaatatta

SEQ ID NO: 112490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agttataatactaatattag

SEQ ID NO: 112491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttataatactaatattagc

SEQ ID NO: 112492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatactaatattagctttt

SEQ ID NO: 112493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atattagcttttaaaaggga

SEQ ID NO: 112494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcttttaaaagggacttaaa

SEQ ID NO: 112495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaaagggacttaaattaa

SEQ ID NO: 112496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaagggacttaaattaag

SEQ ID NO: 112497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaagggacttaaattaaga

SEQ ID NO: 112498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagggacttaaattaagag

SEQ ID NO: 112499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaattaagaggattcctcac

SEQ ID NO: 112500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattaagaggattcctcact

SEQ ID NO: 112501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaggattcctcacttacta

SEQ ID NO: 112502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcacttactaaccacggta

SEQ ID NO: 112503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acttactaaccacggtaatt

SEQ ID NO: 112504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actaaccacggtaatttaaa

SEQ ID NO: 112505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaaccacggtaatttaaaa

SEQ ID NO: 112506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
accacggtaatttaaaaaac

SEQ ID NO: 112507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaacgatatgaatagaa

SEQ ID NO: 112508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaacgatatgaatagaag

SEQ ID NO: 112509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgaaatgttattgtagcca

SEQ ID NO: 112510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaatgttattgtagccatt

SEQ ID NO: 112511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatgttattgtagccattc

SEQ ID NO: 112512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgtagccattccataagtg

SEQ ID NO: 112513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagccattccataagtgtcc

SEQ ID NO: 112514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cataagtgtccttttccata

SEQ ID NO: 112515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttccatagctttagtattca

SEQ ID NO: 112516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccatagctttagtattcag

SEQ ID NO: 112517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccatagctttagtattcagt

SEQ ID NO: 112518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catagctttagtattcagtt

SEQ ID NO: 112519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagtattcagttaagaaata

SEQ ID NO: 112520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtattcagttaagaaataa

SEQ ID NO: 112521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtattcagttaagaaataaa

SEQ ID NO: 112522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agttaagaaataaaaacaac

SEQ ID NO: 112523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaaataaaaacaaccagca

SEQ ID NO: 112524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagcaacctaaagcattggc

SEQ ID NO: 112525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagcattggcttagaaatca

SEQ ID NO: 112526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcttagaaatcagaaagaca

SEQ ID NO: 112527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaaatcagaaagacaaagt

SEQ ID NO: 112528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaatcagaaagacaaagtt

SEQ ID NO: 112529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaatcccagccttatttttc

SEQ ID NO: 112530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttttctccggttggcagg

SEQ ID NO: 112531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttctccggttggcagga

SEQ ID NO: 112532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctccggttggcaggaaga

SEQ ID NO: 112533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctccggttggcaggaagat

SEQ ID NO: 112534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctccggttggcaggaagatg

SEQ ID NO: 112535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccggttggcaggaagatga

SEQ ID NO: 112536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cggttggcaggaagatgact

SEQ ID NO: 112537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcaggaagatgacttgtgtt

SEQ ID NO: 112538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgttagctgaaagacactg

SEQ ID NO: 112539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgttagctgaaagacactga

SEQ ID NO: 112540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctgaaagacactgactttc

SEQ ID NO: 112541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaagacactgactttctaaa

SEQ ID NO: 112542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actttctaaattttatatag

SEQ ID NO: 112543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctaaattttatatagggtt

SEQ ID NO: 112544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaaattttatatagggtta

SEQ ID NO: 112545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaattttatatagggttat

SEQ ID NO: 112546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattttatatagggttatca

SEQ ID NO: 112547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatatagggttatcagtggg

SEQ ID NO: 112548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatagggttatcagtgggt

SEQ ID NO: 112549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatagggttatcagtgggtt

SEQ ID NO: 112550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcagtgggtttctggcaata

SEQ ID NO: 112551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctggcaataagcatttctca

SEQ ID NO: 112552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggcaataagcatttctcac

SEQ ID NO: 112553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcaataagcatttctcaccg

SEQ ID NO: 112554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcaccgtattcaggaggta

SEQ ID NO: 112555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaccgtattcaggaggtaa

SEQ ID NO: 112556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
accgtattcaggaggtaagt

SEQ ID NO: 112557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggaggtaagtctgtgagtc

SEQ ID NO: 112558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgagtcaggctttttatttg

SEQ ID NO: 112559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttatttgtatgcggcagcg

SEQ ID NO: 112560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatttgtatgcggcagcgt

SEQ ID NO: 112561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttgtatgcggcagcgtt

SEQ ID NO: 112562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttgtatgcggcagcgttc

SEQ ID NO: 112563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgtatgcggcagcgttcc

SEQ ID NO: 112564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatgcggcagcgttccctc

SEQ ID NO: 112565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatgcggcagcgttccctca

SEQ ID NO: 112566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctcaagaaaacaaatcaga

SEQ ID NO: 112567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagaaaacaaatcagagtct

SEQ ID NO: 112568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgttttcaggtgtcctttt

SEQ ID NO: 112569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttcaggtgtccttttatt

SEQ ID NO: 112570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaggtgtccttttattttc

SEQ ID NO: 112571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caggtgtccttttattttcc

SEQ ID NO: 112572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggtgtccttttattttcct

SEQ ID NO: 112573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttattttcctgctccctttc

SEQ ID NO: 112574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttcctgctccctttca

SEQ ID NO: 112575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttcctgctccctttcac

SEQ ID NO: 112576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcctgctccctttcact

SEQ ID NO: 112577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctgctccctttcactgta

SEQ ID NO: 112578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgctccctttcactgtat

SEQ ID NO: 112579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgctccctttcactgtatc

SEQ ID NO: 112580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctccctttcactgtatcagt

SEQ ID NO: 112581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctttcactgtatcagttct

SEQ ID NO: 112582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcactgtatcagttctatct

SEQ ID NO: 112583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cactgtatcagttctatcta

SEQ ID NO: 112584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actgtatcagttctatctaa

SEQ ID NO: 112585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatcagttctatctaaatac

SEQ ID NO: 112586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatctaaatacaatttaatg

SEQ ID NO: 112587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctaaatacaatttaatgta

SEQ ID NO: 112588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatacaatttaatgtaaaat

SEQ ID NO: 112589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatgtaaaattcacttttac

SEQ ID NO: 112590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgtaaaattcacttttaca

SEQ ID NO: 112591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acttttacatggaaaattat

SEQ ID NO: 112592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttacatggaaaattatttta

SEQ ID NO: 112593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacatggaaaattattttaa

SEQ ID NO: 112594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatggaaaattattttaaa

SEQ ID NO: 112595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catggaaaattattttaaaa

SEQ ID NO: 112596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaaaattaatacctagt

SEQ ID NO: 112597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaattaatacctagtcct

SEQ ID NO: 112598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaattaatacctagtcctc

SEQ ID NO: 112599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattaatacctagtcctca

SEQ ID NO: 112600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atacctagtcctcaagtaca

SEQ ID NO: 112601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtcctcaagtacaatccttt

SEQ ID NO: 112602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagtacaatcctttttgtct

SEQ ID NO: 112603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttgtcttaaatctcagtag

SEQ ID NO: 112604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtcttaaatctcagtaga

SEQ ID NO: 112605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtcttaaatctcagtagac

SEQ ID NO: 112606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcttaaatctcagtagact

SEQ ID NO: 112607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttaaatctcagtagactg

SEQ ID NO: 112608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaatctcagtagactgtatt

SEQ ID NO: 112609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatctcagtagactgtattt

SEQ ID NO: 112610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agtagactgtatttttaaaa

SEQ ID NO: 112611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatttttaaaaaattattca

SEQ ID NO: 112612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaaaattattcatccat

SEQ ID NO: 112613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaaattattcatccatt

SEQ ID NO: 112614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaattattcatccattc

SEQ ID NO: 112615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaattattcatccattct

SEQ ID NO: 112616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcatccattctttctgcaa

SEQ ID NO: 112617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atccattctttctgcaattg

SEQ ID NO: 112618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctgcaattgtattgaca

SEQ ID NO: 112619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctgcaattgtattgacatg

SEQ ID NO: 112620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgcaattgtattgacatgg

SEQ ID NO: 112621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcaattgtattgacatggt

SEQ ID NO: 112622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caattgtattgacatggttt

SEQ ID NO: 112623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattgacatggtttggctct

SEQ ID NO: 112624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acatggtttggctctgtgtc

SEQ ID NO: 112625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggctctgtgtccccgcccaa

SEQ ID NO: 112626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctctgtgtccccgcccaaa

SEQ ID NO: 112627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtgtccccgcccaaatctc

SEQ ID NO: 112628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtccccgcccaaatctcat

SEQ ID NO: 112629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attttgaattgtaatcccca

SEQ ID NO: 112630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaattgtaatccccacgtc

SEQ ID NO: 112631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaattgtaatccccacgtct

SEQ ID NO: 112632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattgtaatccccacgtctc

SEQ ID NO: 112633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatccccacgtctcagggg

SEQ ID NO: 112634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggggagggacctggtggta

SEQ ID NO: 112635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtggtaagtgattggatcat

SEQ ID NO: 112636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gatcatgggagcggtttccc

SEQ ID NO: 112637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccccagtgctgttctcatga

SEQ ID NO: 112638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccagtgctgttctcatgat

SEQ ID NO: 112639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttctcatgatagtgagtgag

SEQ ID NO: 112640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcatgatagtgagtgagtga

SEQ ID NO: 112641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgatagtgagtgagtgagt

SEQ ID NO: 112642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcatgagatctgatgggttt

SEQ ID NO: 112643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgagatctgatgggtttaa

SEQ ID NO: 112644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgggtttaaaagtgcggca

SEQ ID NO: 112645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaagtgcggcatttccctc

SEQ ID NO: 112646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagtgcggcatttccctcc

SEQ ID NO: 112647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctcctctttctccctctc

SEQ ID NO: 112648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctcctctttctccctctcc

SEQ ID NO: 112649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctctttctccctctcctgca

SEQ ID NO: 112650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttctccctctcctgcacca

SEQ ID NO: 112651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctccctctcctgcaccatg

SEQ ID NO: 112652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctccctctcctgcaccatgt

SEQ ID NO: 112653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccctctcctgcaccatgtt

SEQ ID NO: 112654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctctcctgcaccatgttaa

SEQ ID NO: 112655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcctgcaccatgttaagatg

SEQ ID NO: 112656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgcaccatgttaagatgtg

SEQ ID NO: 112657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caccatgttaagatgtgcct

SEQ ID NO: 112658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agatgtgccttgcttcccct

SEQ ID NO: 112659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcttcccctttgccttcgac

SEQ ID NO: 112660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttcccctttgccttcgacc

SEQ ID NO: 112661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccctttgccttcgaccatg

SEQ ID NO: 112662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccctttgccttcgaccatga

SEQ ID NO: 112663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgccttcgaccatgattgta

SEQ ID NO: 112664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccttcgaccatgattgtaa

SEQ ID NO: 112665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccttcgaccatgattgtaag

SEQ ID NO: 112666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cgaccatgattgtaagtttt

SEQ ID NO: 112667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gaccatgattgtaagttttc

SEQ ID NO: 112668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagttttctgaggcctccc

SEQ ID NO: 112669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgaggcctcccctgccat

SEQ ID NO: 112670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaggcctcccctgccatt

SEQ ID NO: 112671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaggcctcccctgccattc

SEQ ID NO: 112672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggcctcccctgccattcag

SEQ ID NO: 112673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccctgccattcagaacagtg

SEQ ID NO: 112674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccattcagaacagtgagtaa

SEQ ID NO: 112675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaacagtgagtaaattaaa

SEQ ID NO: 112676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatctcttttctttataaat

SEQ ID NO: 112677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttctttataaattaccca

SEQ ID NO: 112678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctttataaattacccagt

SEQ ID NO: 112679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttataaattacccagtc

SEQ ID NO: 112680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttataaattacccagtct

SEQ ID NO: 112681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttataaattacccagtctc

SEQ ID NO: 112682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tataaattacccagtctcag

SEQ ID NO: 112683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataaattacccagtctcagg

SEQ ID NO: 112684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaattacccagtctcaggt

SEQ ID NO: 112685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccagtctcaggtagttctt

SEQ ID NO: 112686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggtagttctttatagcagt

SEQ ID NO: 112687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttatagcagtgtaaaaatg

SEQ ID NO: 112688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatagcagtgtaaaaatgga

SEQ ID NO: 112689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagcagtgtaaaaatggac

SEQ ID NO: 112690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagcagtgtaaaaatggact

SEQ ID NO: 112691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atacggccgggcgtggtggc

SEQ ID NO: 112692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acgcctgtgttcccagcact

SEQ ID NO: 112693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgttcccagcactttgggag

SEQ ID NO: 112694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccagcactttgggaggccaa

SEQ ID NO: 112695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgggaggccaaggtgggcag

SEQ ID NO: 112696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggaggccaaggtgggcaga

SEQ ID NO: 112697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaggccaaggtgggcagaa

SEQ ID NO: 112698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctaacacggtgaatccccg

SEQ ID NO: 112699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acacggtgaatccccgtctc

SEQ ID NO: 112700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tactaaaaatacaaaaacaa

SEQ ID NO: 112701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaaaaatacaaaaacaaaa

SEQ ID NO: 112702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaatacaaaaacaaaatta

SEQ ID NO: 112703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccaggtgtggtggcgggta

SEQ ID NO: 112704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagtcccagctaccctggag

SEQ ID NO: 112705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccctggaggctgaggtggga

SEQ ID NO: 112706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaggctgaggtgggagaatg

SEQ ID NO: 112707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggtgggagaatggcgtgaa

SEQ ID NO: 112708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcagtgagccaaaatcgcgc

SEQ ID NO: 112709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagtgagccaaaatcgcgcc

SEQ ID NO: 112710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagcctgggcaacagaggga

SEQ ID NO: 112711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcaacagagggagactctg

SEQ ID NO: 112712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtctcaaaaaaaaaaaaaa

SEQ ID NO: 112713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctcaaaaaaaaaaaaaaaa

SEQ ID NO: 112714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaaaaaaaaaaaaaaaaaa

SEQ ID NO: 112715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atacatgtatagtcagaaac

SEQ ID NO: 112716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatcataacaggtaatgaaa

SEQ ID NO: 112717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaacaaaaataaggcatgag

SEQ ID NO: 112718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacaaaaataaggcatgagt

SEQ ID NO: 112719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtattcaaggaacttccta

SEQ ID NO: 112720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtattcaaggaacttcctag

SEQ ID NO: 112721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattcaaggaacttcctaga

SEQ ID NO: 112722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaggaacttcctagaaaaat

SEQ ID NO: 112723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctagaaaaatgaaaagaag

SEQ ID NO: 112724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctagaaaaatgaaaagaaga

SEQ ID NO: 112725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaaaatgaaaagaagaaag

SEQ ID NO: 112726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atataaggcaagatgtgaca

SEQ ID NO: 112727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcaaaattatcagggagact

SEQ ID NO: 112728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcagggagactttataaacc

SEQ ID NO: 112729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tataaaccggaggtcatctg

SEQ ID NO: 112730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataaaccggaggtcatctga

SEQ ID NO: 112731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaaccggaggtcatctgag

SEQ ID NO: 112732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agctaacatgaaaaatcaca

SEQ ID NO: 112733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acatgaaaaatcacaacata

SEQ ID NO: 112734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catagtattggcaagatcaa

SEQ ID NO: 112735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcaagatcaagttaccttat

SEQ ID NO: 112736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccttatacttgaaattttaa

SEQ ID NO: 112737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atacttgaaattttaataaa

SEQ ID NO: 112738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacttgaaattttaataaaa

SEQ ID NO: 112739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaattttaataaaaagaat

SEQ ID NO: 112740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaattttaataaaaagaatt

SEQ ID NO: 112741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taataaaaagaattgttggt

SEQ ID NO: 112742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aataaaaagaattgttggta

SEQ ID NO: 112743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataaaaagaattgttggtat

SEQ ID NO: 112744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttggtattttaaaattgaaa

SEQ ID NO: 112745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtattttaaaattgaaatta

SEQ ID NO: 112746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaattgaaattagcaatt

SEQ ID NO: 112747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaattgaaattagcaattt

SEQ ID NO: 112748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattgaaattagcaatttt

SEQ ID NO: 112749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaattagcaattttcattct

SEQ ID NO: 112750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaattttcattctcattaa

SEQ ID NO: 112751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattctcattaaaaacttt

SEQ ID NO: 112752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattctcattaaaaactttt

SEQ ID NO: 112753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attctcattaaaaactttta

SEQ ID NO: 112754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcattaaaaacttttaagtg

SEQ ID NO: 112755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attaaaaacttttaagtgat

SEQ ID NO: 112756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaacttttaagtgattttt

SEQ ID NO: 112757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaagtgatttttgggtctg

SEQ ID NO: 112758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagtgatttttgggtctgc

SEQ ID NO: 112759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagtgatttttgggtctgca

SEQ ID NO: 112760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtgatttttgggtctgcat

SEQ ID NO: 112761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgggtctgcatacacatga

SEQ ID NO: 112762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgggtctgcatacacatgag

SEQ ID NO: 112763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggtctgcatacacatgaga

SEQ ID NO: 112764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggtctgcatacacatgagag

SEQ ID NO: 112765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catacacatgagagttaatt

SEQ ID NO: 112766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attattagcaggaaaaaata

SEQ ID NO: 112767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttagcaggaaaaaataggta

SEQ ID NO: 112768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaggaaaaaataggtatga

SEQ ID NO: 112769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaaatttggcagatcactg

SEQ ID NO: 112770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcagatcactgtgtcatgt

SEQ ID NO: 112771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcagatcactgtgtcatgtc

SEQ ID NO: 112772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtcatgtccaaaaatgtta

SEQ ID NO: 112773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgctaaacaattatactaaa

SEQ ID NO: 112774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacaattatactaaacaatg

SEQ ID NO: 112775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactaaacaatgtatactat

SEQ ID NO: 112776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacaatgtatactatgttat

SEQ ID NO: 112777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgttatactaaacattatac

SEQ ID NO: 112778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactaaacattatactaaat

SEQ ID NO: 112779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacattatactaaatttcac

SEQ ID NO: 112780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactaaatttcacaattgct

SEQ ID NO: 112781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatttcacaattgcttcaaa

SEQ ID NO: 112782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacaattgcttcaaagagaa

SEQ ID NO: 112783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaattgcttcaaagagaat

SEQ ID NO: 112784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttcaaagagaataaaatac

SEQ ID NO: 112785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaagagaataaaataccta

SEQ ID NO: 112786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaagagaataaaatacctag

SEQ ID NO: 112787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggaatccaacttacaaggga

SEQ ID NO: 112788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acaagggatgtgaaggacct

SEQ ID NO: 112789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caagggatgtgaaggacctc

SEQ ID NO: 112790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcgaggagaactacaaacc

SEQ ID NO: 112791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cgaggagaactacaaaccac

SEQ ID NO: 112792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gaggagaactacaaaccact

SEQ ID NO: 112793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaaccactgctcaaggaaa

SEQ ID NO: 112794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctcaaggaaataaaagagga

SEQ ID NO: 112795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaggaaataaaagaggatac

SEQ ID NO: 112796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catgctcatgtgtaggaaga

SEQ ID NO: 112797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgtgtaggaagaatcaata

SEQ ID NO: 112798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cccaaggtaatttacagatt

SEQ ID NO: 112799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acagattcaatgccatcccc

SEQ ID NO: 112800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagattcaatgccatcccca

SEQ ID NO: 112801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgccatccccatcaagct

SEQ ID NO: 112802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccaatgactttcttcacaga

SEQ ID NO: 112803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttcacagaactggaaaaa

SEQ ID NO: 112804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcacagaactggaaaaaa

SEQ ID NO: 112805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcacagaactggaaaaaac

SEQ ID NO: 112806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacagaactggaaaaaacta

SEQ ID NO: 112807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acagaactggaaaaaactac

SEQ ID NO: 112808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaaaaactactttaaagtt

SEQ ID NO: 112809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctttaaagttcatatggaac

SEQ ID NO: 112810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaagttcatatggaaccaa

SEQ ID NO: 112811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagttcatatggaaccaaa

SEQ ID NO: 112812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagttcatatggaaccaaaa

SEQ ID NO: 112813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatggaaccaaaaaagagc

SEQ ID NO: 112814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agccaaaagaacaaagctgg

SEQ ID NO: 112815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaggcatcacgctacctgac

SEQ ID NO: 112816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctgacttcaaactacacta

SEQ ID NO: 112817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acttcaaactacactacaag

SEQ ID NO: 112818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaactacactacaaggcta

SEQ ID NO: 112819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaactacactacaaggctac

SEQ ID NO: 112820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cactacaaggctacagtaac

SEQ ID NO: 112821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaggctacagtaacccaaa

SEQ ID NO: 112822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagtaacccaaacagcatgg

SEQ ID NO: 112823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtaccaaaacagagatatag

SEQ ID NO: 112824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaaataacgccacatatct

SEQ ID NO: 112825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caactatctgatctttgaca

SEQ ID NO: 112826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctgatctttgacaaacctg

SEQ ID NO: 112827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atctttgacaaacctgagaa

SEQ ID NO: 112828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgacaaacctgagaaaaaca

SEQ ID NO: 112829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacaaacctgagaaaaacaa

SEQ ID NO: 112830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acaaacctgagaaaaacaag

SEQ ID NO: 112831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaaaaacaagcaatgggga

SEQ ID NO: 112832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctatttaacaaatggtgct

SEQ ID NO: 112833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttaacaaatggtgctggga

SEQ ID NO: 112834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacaaatggtgctgggaaaa

SEQ ID NO: 112835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaaatggtgctgggaaaac

SEQ ID NO: 112836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaaaactggctagccatat

SEQ ID NO: 112837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctagccatatgtagaaagc

SEQ ID NO: 112838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gccatatgtagaaagctgaa

SEQ ID NO: 112839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaactggatcccttccttac

SEQ ID NO: 112840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatcccttccttacacctta

SEQ ID NO: 112841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttacaccttatacaaaaa

SEQ ID NO: 112842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttacaccttatacaaaaat

SEQ ID NO: 112843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acaccttatacaaaaatcaa

SEQ ID NO: 112844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caccttatacaaaaatcaat

SEQ ID NO: 112845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atacaaaaatcaattcaaga

SEQ ID NO: 112846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacaaaaatcaattcaagat

SEQ ID NO: 112847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagatggattaaagacttaa

SEQ ID NO: 112848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagacttaaacattagacct

SEQ ID NO: 112849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaacattagacctaaaacca

SEQ ID NO: 112850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacattagacctaaaaccat

SEQ ID NO: 112851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gacctaaaaccataaaaacc

SEQ ID NO: 112852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaccataaaaaccctagaa

SEQ ID NO: 112853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaagaaaacccaggcattac

SEQ ID NO: 112854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccattcaggacataggcatg

SEQ ID NO: 112855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggacataggcatgggcaag

SEQ ID NO: 112856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catgtctaaaacaccaaaag

SEQ ID NO: 112857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtctaaaacaccaaaagc

SEQ ID NO: 112858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaacaccaaaagcaatggca

SEQ ID NO: 112859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acaaatgggatctaattaaa

SEQ ID NO: 112860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attaaactaaagagcttctg

SEQ ID NO: 112861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aactaaagagcttctgcaca

SEQ ID NO: 112862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagagcttctgcacagcaaa

SEQ ID NO: 112863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgcacagcaaaataaacta

SEQ ID NO: 112864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcacagcaaaataaactac

SEQ ID NO: 112865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cacagcaaaataaactacca

SEQ ID NO: 112866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccatcagagtgaacatgcaa

SEQ ID NO: 112867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaaatgggagacaattttc

SEQ ID NO: 112868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcgcaacctactcatctgac

SEQ ID NO: 112869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgcaacctactcatctgaca

SEQ ID NO: 112870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gcaacctactcatctgacaa

SEQ ID NO: 112871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcatctgacaaaaggctaa

SEQ ID NO: 112872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atctgacaaaaggctaatat

SEQ ID NO: 112873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acaaaaggctaatatccaga

SEQ ID NO: 112874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atatccagaatctacaatga

SEQ ID NO: 112875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caatgaactcaaacaaattt

SEQ ID NO: 112876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaacaaatttacaagaaaaa

SEQ ID NO: 112877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaagaaaaaaacaaacaac

SEQ ID NO: 112878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caagaaaaaaacaaacaacc

SEQ ID NO: 112879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcaaaagaagacatttatg

SEQ ID NO: 112880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaaaagaagacatttatgc

SEQ ID NO: 112881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaagaagacatttatgcag

SEQ ID NO: 112882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgcagccaaaaaacacatg

SEQ ID NO: 112883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcagccaaaaaacacatga

SEQ ID NO: 112884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atcatcactggccatcagag

SEQ ID NO: 112885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gccatcagagaaatgcaaat

SEQ ID NO: 112886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acaccagttagaatggcaat

SEQ ID NO: 112887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatggcaatcattaaaaag

SEQ ID NO: 112888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaagtcaggaaacaacagg

SEQ ID NO: 112889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagaggatgtggagaaatag

SEQ ID NO: 112890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttacactgttggtggtaaac

SEQ ID NO: 112891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacactgttggtggtaaact

SEQ ID NO: 112892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acactgttggtggtaaacta

SEQ ID NO: 112893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cactgttggtggtaaactag

SEQ ID NO: 112894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttggtggtaaactagttcaa

SEQ ID NO: 112895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtggtaaactagttcaacca

SEQ ID NO: 112896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gttcaaccattgtggaagtc

SEQ ID NO: 112897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaccattgtggaagtcagtg

SEQ ID NO: 112898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggaagtcagtgtggcgatt

SEQ ID NO: 112899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcagggatctagaactaga

SEQ ID NO: 112900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agggatctagaactagaaat

SEQ ID NO: 112901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaactagaaataccatttga

SEQ ID NO: 112902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaataccatttgacccagc

SEQ ID NO: 112903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacccagccatcccattact

SEQ ID NO: 112904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acccagccatcccattactg

SEQ ID NO: 112905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgggtatatacccaaagga

SEQ ID NO: 112906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtatatacccaaaggacta

SEQ ID NO: 112907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaatcatgctgctataaag

SEQ ID NO: 112908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctataaagacacatgcacac

SEQ ID NO: 112909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaagacacatgcacacata

SEQ ID NO: 112910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgtggcattattcacaat

SEQ ID NO: 112911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgtggcattattcacaata

SEQ ID NO: 112912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggcattattcacaatagca

SEQ ID NO: 112913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcacaatagcaaacacttg

SEQ ID NO: 112914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaatagcaaacacttggaa

SEQ ID NO: 112915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaaccaacccaaatgtcca

SEQ ID NO: 112916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaccaacccaaatgtccaa

SEQ ID NO: 112917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gattaagaaaatgtggctca

SEQ ID NO: 112918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaaaatgtggctcatatac

SEQ ID NO: 112919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atatacaccatggaatacta

SEQ ID NO: 112920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgcagccataaaaaatgatg

SEQ ID NO: 112921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acgtcctttgtagggacatg

SEQ ID NO: 112922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtagggacatggatgcaat

SEQ ID NO: 112923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtagggacatggatgcaatt

SEQ ID NO: 112924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagggacatggatgcaattg

SEQ ID NO: 112925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaatcatcattctcagtaa

SEQ ID NO: 112926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcagtaaactatcacaagaa

SEQ ID NO: 112927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agtaaactatcacaagaata

SEQ ID NO: 112928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcacaagaataaaaaaccaa

SEQ ID NO: 112929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcactcataggtgggaattg

SEQ ID NO: 112930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actcataggtgggaattgaa

SEQ ID NO: 112931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataggtgggaattgaacaat

SEQ ID NO: 112932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacaatgaaatcacatggac

SEQ ID NO: 112933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagggactgtggtggggtgg

SEQ ID NO: 112934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gggactgtggtggggtgggg

SEQ ID NO: 112935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggtggggtggggggagggg

SEQ ID NO: 112936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggagatatacctaatgctag

SEQ ID NO: 112937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgctagatgaccagttagt

SEQ ID NO: 112938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatgaccagttagtgggtgc

SEQ ID NO: 112939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgggtgcagcgcaccagca

SEQ ID NO: 112940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acctgcacaatgtgcacatg

SEQ ID NO: 112941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cacaatgtgcacatgtaccc

SEQ ID NO: 112942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaacttaaagtataattaaa

SEQ ID NO: 112943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaagtataattaaaaaaaaa

SEQ ID NO: 112944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtataattaaaaaaaaaa

SEQ ID NO: 112945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaaaaaattaaaagtag

SEQ ID NO: 112946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagtagtatgccaatgcca

SEQ ID NO: 112947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatgaaaaatttgaaaaag

SEQ ID NO: 112948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgaaaaatttgaaaaagt

SEQ ID NO: 112949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaaagtacagattctgaa

SEQ ID NO: 112950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaagtacagattctgaat

SEQ ID NO: 112951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaatatcctatatatatat

SEQ ID NO: 112952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatatcctatatatatatat

SEQ ID NO: 112953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatatatatatatatatata

SEQ ID NO: 112954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttaacattctggtcatg

SEQ ID NO: 112955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttaacattctggtcatga

SEQ ID NO: 112956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacattctggtcatgatatg

SEQ ID NO: 112957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acattctggtcatgatatgg

SEQ ID NO: 112958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggtcatgatatggttattc

SEQ ID NO: 112959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtcatgatatggttattcac

SEQ ID NO: 112960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcactaaatttcactaatc

SEQ ID NO: 112961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actaaatttcactaatctca

SEQ ID NO: 112962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatttcactaatctcaattt

SEQ ID NO: 112963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cactaatctcaatttaaaat

SEQ ID NO: 112964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actaatctcaatttaaaata

SEQ ID NO: 112965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atctcaatttaaaataattt

SEQ ID NO: 112966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatttaaaataatttttata

SEQ ID NO: 112967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaataatttttatacagaa

SEQ ID NO: 112968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaataatttttatacagaag

SEQ ID NO: 112969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatacagaaggaagccaac

SEQ ID NO: 112970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatacagaaggaagccaaca

SEQ ID NO: 112971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atacagaaggaagccaacag

SEQ ID NO: 112972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacagaaggaagccaacaga

SEQ ID NO: 112973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
accactgaagtcaaaataaa

SEQ ID NO: 112974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagtcaaaataaactcacct

SEQ ID NO: 112975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acctttttgtctgcatagta

SEQ ID NO: 112976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttgtctgcatagtaggggt

SEQ ID NO: 112977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtctgcatagtaggggtc

SEQ ID NO: 112978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtctgcatagtaggggtcc

SEQ ID NO: 112979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtctgcatagtaggggtcca

SEQ ID NO: 112980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctgcatagtaggggtccaa

SEQ ID NO: 112981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catagtaggggtccaagtcc

SEQ ID NO: 112982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caggggctctgacaccatgc

SEQ ID NO: 112983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgacaccatgccgggaggaa

SEQ ID NO: 112984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acaccatgccgggaggaatg

SEQ ID NO: 112985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttgccagcttccaagtcac

SEQ ID NO: 112986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccagcttccaagtcactgc

SEQ ID NO: 112987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccagcttccaagtcactgct

SEQ ID NO: 112988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaagtcactgcttggcttt

SEQ ID NO: 112989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caagtcactgcttggctttg

SEQ ID NO: 112990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttggctttggggcttcttc

SEQ ID NO: 112991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggctttggggcttcttcatc

SEQ ID NO: 112992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctttggggcttcttcatca

SEQ ID NO: 112993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggggcttcttcatcatcat

SEQ ID NO: 112994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggggcttcttcatcatcatc

SEQ ID NO: 112995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggcttcttcatcatcatct

SEQ ID NO: 112996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttcatcatcatctttcttt

SEQ ID NO: 112997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcatcatcatctttctttt

SEQ ID NO: 112998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catcatcatctttcttttct

SEQ ID NO: 112999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcatcatctttcttttctt

SEQ ID NO: 113000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttttcttctttgggttcc

SEQ ID NO: 113001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttcttctttgggttcct

SEQ ID NO: 113002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttcttctttgggttcctt

SEQ ID NO: 113003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcttctttgggttcctttg

SEQ ID NO: 113004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttctttgggttcctttga

SEQ ID NO: 113005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttctttgggttcctttgat

SEQ ID NO: 113006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctttgggttcctttgatt

SEQ ID NO: 113007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttgggttcctttgatttt

SEQ ID NO: 113008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttgggttcctttgattttc

SEQ ID NO: 113009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgggttcctttgattttctt

SEQ ID NO: 113010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggttcctttgattttcttt

SEQ ID NO: 113011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggttcctttgattttctttc

SEQ ID NO: 113012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttgattttctttcagcaa

SEQ ID NO: 113013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgattttctttcagcaatgc

SEQ ID NO: 113014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gattttctttcagcaatgcg

SEQ ID NO: 113015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attttctttcagcaatgcgt

SEQ ID NO: 113016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttcagcaatgcgttgtt

SEQ ID NO: 113017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcagcaatgcgttgttc

SEQ ID NO: 113018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcagcaatgcgttgttca

SEQ ID NO: 113019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcagcaatgcgttgttcaat

SEQ ID NO: 113020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagcaatgcgttgttcaatg

SEQ ID NO: 113021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agcaatgcgttgttcaatga

SEQ ID NO: 113022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttcaatgagggcaagagact

SEQ ID NO: 113023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgagggcaagagactgtt

SEQ ID NO: 113024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttgtgaaatggacaaagc

SEQ ID NO: 113025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgaaatggacaaagctct

SEQ ID NO: 113026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgaaatggacaaagctctg

SEQ ID NO: 113027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaaatggacaaagctctga

SEQ ID NO: 113028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgaggtcctgggggaggcaa

SEQ ID NO: 113029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggtcctgggggaggcaaca

SEQ ID NO: 113030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggggaggcaacattgccatc

SEQ ID NO: 113031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccatcttttcatcctgtata

SEQ ID NO: 113032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcatcctgtatattttaat

SEQ ID NO: 113033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatcctgtatattttaatt

SEQ ID NO: 113034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catcctgtatattttaattc

SEQ ID NO: 113035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcctgtatattttaattcc

SEQ ID NO: 113036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatattttaattcctcttca

SEQ ID NO: 113037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattcctcttcagctcctc

SEQ ID NO: 113038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattcctcttcagctcctca

SEQ ID NO: 113039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attcctcttcagctcctcac

SEQ ID NO: 113040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcttcagctcctcacataa

SEQ ID NO: 113041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcagctcctcacataagag

SEQ ID NO: 113042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagctcctcacataagaggc

SEQ ID NO: 113043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agctcctcacataagaggcc

SEQ ID NO: 113044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcacataagaggcctggat

SEQ ID NO: 113045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acataagaggcctggatgga

SEQ ID NO: 113046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatggaaacaaagaaataaa

SEQ ID NO: 113047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aactatttgcctgccaagaa

SEQ ID NO: 113048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actatttgcctgccaagaaa

SEQ ID NO: 113049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttgcctgccaagaaaggcc

SEQ ID NO: 113050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcctgccaagaaaggcccat

SEQ ID NO: 113051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctgccaagaaaggcccatt

SEQ ID NO: 113052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccaagaaaggcccattaaaa

SEQ ID NO: 113053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaactaataataacaacat

SEQ ID NO: 113054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ataataacaacataaacaga

SEQ ID NO: 113055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagtttcaactacaaaagg

SEQ ID NO: 113056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagtttcaactacaaaaggt

SEQ ID NO: 113057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtttcaactacaaaaggta

SEQ ID NO: 113058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtttcaactacaaaaggtaa

SEQ ID NO: 113059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caactacaaaaggtaacatg

SEQ ID NO: 113060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aactacaaaaggtaacatgt

SEQ ID NO: 113061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaaaggtaacatgttctag

SEQ ID NO: 113062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagaattatcagcttgttaa

SEQ ID NO: 113063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaattatcagcttgttaagg

SEQ ID NO: 113064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcagcttgttaagggattac

SEQ ID NO: 113065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttaagggattactatgtgt

SEQ ID NO: 113066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaagggattactatgtgtc

SEQ ID NO: 113067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agggattactatgtgtcagg

SEQ ID NO: 113068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctatgtgtcaggcaatgggc

SEQ ID NO: 113069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtgtcaggcaatgggcggg

SEQ ID NO: 113070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atctttcgtgccttctaacc

SEQ ID NO: 113071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctttcgtgccttctaacca

SEQ ID NO: 113072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcgtgccttctaaccatctt

SEQ ID NO: 113073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgtgccttctaaccatcttt

SEQ ID NO: 113074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gtgccttctaaccatcttta

SEQ ID NO: 113075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaaccatctttatactcag

SEQ ID NO: 113076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaccatctttatactcaga

SEQ ID NO: 113077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
accatctttatactcagaaa

SEQ ID NO: 113078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatactcagaaatttgaagt

SEQ ID NO: 113079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atactcagaaatttgaagtt

SEQ ID NO: 113080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactcagaaatttgaagttt

SEQ ID NO: 113081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaaatttgaagtttacgct

SEQ ID NO: 113082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaagtttacgcttcatagct

SEQ ID NO: 113083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagtttacgcttcatagctt

SEQ ID NO: 113084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acgcttcatagctttaaagt

SEQ ID NO: 113085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cgcttcatagctttaaagta

SEQ ID NO: 113086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catagctttaaagtaaaaaa

SEQ ID NO: 113087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atagctttaaagtaaaaaat

SEQ ID NO: 113088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaagtaaaaaatgacaatt

SEQ ID NO: 113089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagtaaaaaatgacaattt

SEQ ID NO: 113090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtaaaaaatgacaatttt

SEQ ID NO: 113091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgagtaaattttcctaaa

SEQ ID NO: 113092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgagtaaattttcctaaat

SEQ ID NO: 113093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgagtaaattttcctaaatt

SEQ ID NO: 113094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtaaattttcctaaattcc

SEQ ID NO: 113095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctaaattccccttctttt

SEQ ID NO: 113096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctaaattccccttcttttc

SEQ ID NO: 113097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctaaattccccttcttttcg

SEQ ID NO: 113098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattccccttcttttcgtct

SEQ ID NO: 113099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccttcttttcgtctatatt

SEQ ID NO: 113100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttttcgtctatatttacct

SEQ ID NO: 113101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttcgtctatatttacctt

SEQ ID NO: 113102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcgtctatatttacctttg

SEQ ID NO: 113103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcgtctatatttacctttgg

SEQ ID NO: 113104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgtctatatttacctttggt

SEQ ID NO: 113105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gtctatatttacctttggtg

SEQ ID NO: 113106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatttacctttggtgcaatt

SEQ ID NO: 113107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acctttggtgcaattcaact

SEQ ID NO: 113108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctttggtgcaattcaactc

SEQ ID NO: 113109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggtgcaattcaactcaact

SEQ ID NO: 113110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtgcaattcaactcaactt

SEQ ID NO: 113111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgcaattcaactcaacttt

SEQ ID NO: 113112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aactcaactttcctctttta

SEQ ID NO: 113113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aactttcctcttttaaaagt

SEQ ID NO: 113114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcctcttttaaaagtcttta

SEQ ID NO: 113115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctcttttaaaagtctttat

SEQ ID NO: 113116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcttttaaaagtctttatg

SEQ ID NO: 113117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttaaaagtctttatgata

SEQ ID NO: 113118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaaagtctttatgataat

SEQ ID NO: 113119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaagtctttatgataatg

SEQ ID NO: 113120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaagtctttatgataatgc

SEQ ID NO: 113121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagtctttatgataatgcc

SEQ ID NO: 113122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatgataatgcctttggtag

SEQ ID NO: 113123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgataatgcctttggtagc

SEQ ID NO: 113124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgataatgcctttggtagca

SEQ ID NO: 113125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggtagcaccactctccagc

SEQ ID NO: 113126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtagcaccactctccagcc

SEQ ID NO: 113127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtagcaccactctccagcct

SEQ ID NO: 113128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tccagcctgatgctgtttta

SEQ ID NO: 113129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagcctgatgctgttttacc

SEQ ID NO: 113130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgctgttttaccaactaaa

SEQ ID NO: 113131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttaccaactaaacttatg

SEQ ID NO: 113132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taccaactaaacttatgtaa

SEQ ID NO: 113133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
accaactaaacttatgtaat

SEQ ID NO: 113134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccaactaaacttatgtaata

SEQ ID NO: 113135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacttatgtaatattctaaa

SEQ ID NO: 113136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgtaatattctaaatcctc

SEQ ID NO: 113137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtaatattctaaatcctct

SEQ ID NO: 113138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaatcctctgctgtcactt

SEQ ID NO: 113139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatcctctgctgtcacttca

SEQ ID NO: 113140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgctgtcacttcaacaatgt

SEQ ID NO: 113141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctgtcacttcaacaatgttc

SEQ ID NO: 113142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcacttcaacaatgttcata

SEQ ID NO: 113143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caacaatgttcataacatct

SEQ ID NO: 113144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacaatgttcataacatctt

SEQ ID NO: 113145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataacatcttgaccaggaga

SEQ ID NO: 113146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaccaggagaagattccatc

SEQ ID NO: 113147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
accaggagaagattccatct

SEQ ID NO: 113148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catctcacgaaaccactttc

SEQ ID NO: 113149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acgaaaccactttctttgct

SEQ ID NO: 113150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttgcttatcaatcagaa

SEQ ID NO: 113151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttgcttatcaatcagaag

SEQ ID NO: 113152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttgcttatcaatcagaagc

SEQ ID NO: 113153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcttatcaatcagaagcaa

SEQ ID NO: 113154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttatcaatcagaagcaac

SEQ ID NO: 113155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttatcaatcagaagcaact

SEQ ID NO: 113156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atcaatcagaagcaactcct

SEQ ID NO: 113157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaatcagaagcaactcctc

SEQ ID NO: 113158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcatccattcaagttaccg

SEQ ID NO: 113159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atccattcaagttaccgcga

SEQ ID NO: 113160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagttaccgcgagatggcag

SEQ ID NO: 113161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccgcgagatggcagcaattc

SEQ ID NO: 113162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtcacaattttaggctcca

SEQ ID NO: 113163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taggctccatctcttaattc

SEQ ID NO: 113164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggctccatctcttaattct

SEQ ID NO: 113165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggctccatctcttaattcta

SEQ ID NO: 113166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catctcttaattctaattct

SEQ ID NO: 113167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaattctaattctcttgct

SEQ ID NO: 113168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aattctaattctcttgctat

SEQ ID NO: 113169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attctaattctcttgctatt

SEQ ID NO: 113170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taattctcttgctatttcca

SEQ ID NO: 113171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attctcttgctatttccacc

SEQ ID NO: 113172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttgctatttccaccacat

SEQ ID NO: 113173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgctatttccaccacatct

SEQ ID NO: 113174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctatttccaccacatctgc

SEQ ID NO: 113175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctatttccaccacatctgca

SEQ ID NO: 113176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttccaccacatctgcagtt

SEQ ID NO: 113177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaccacatctgcagttctt

SEQ ID NO: 113178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caccacatctgcagttcttt

SEQ ID NO: 113179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagttctttccatcactgaa

SEQ ID NO: 113180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttccatcactgaagtctta

SEQ ID NO: 113181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccatcactgaagtcttaaa

SEQ ID NO: 113182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccatcactgaagtcttaaac

SEQ ID NO: 113183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catcactgaagtcttaaacc

SEQ ID NO: 113184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagtcttaaacctctcatag

SEQ ID NO: 113185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaacctctcatagtcatcca

SEQ ID NO: 113186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacctctcatagtcatccat

SEQ ID NO: 113187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcatagtcatccatgagagt

SEQ ID NO: 113188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atagtcatccatgagagttg

SEQ ID NO: 113189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaatcaactcattccaattt

SEQ ID NO: 113190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attccaatttcctattaatg

SEQ ID NO: 113191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caatttcctattaatgtttg

SEQ ID NO: 113192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctattaatgtttgtatatt

SEQ ID NO: 113193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctattaatgtttgtatattg

SEQ ID NO: 113194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttaatgtttgtatattgccc

SEQ ID NO: 113195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgtttgtatattgccctcc

SEQ ID NO: 113196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatattgccctcctcccac

SEQ ID NO: 113197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatattgccctcctcccaca

SEQ ID NO: 113198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccctcctcccacaaatcatt

SEQ ID NO: 113199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcccacaaatcattaatgt

SEQ ID NO: 113200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccacaaatcattaatgttct

SEQ ID NO: 113201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgttctaataacatctaga

SEQ ID NO: 113202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taataacatctagaatggtg

SEQ ID NO: 113203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ataacatctagaatggtgaa

SEQ ID NO: 113204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaatggtgaatcctttccag

SEQ ID NO: 113205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccagaagattttcaattta

SEQ ID NO: 113206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccagaagattttcaatttac

SEQ ID NO: 113207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagaagattttcaatttact

SEQ ID NO: 113208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaatttacttttcccagac

SEQ ID NO: 113209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatttacttttcccagacc

SEQ ID NO: 113210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatttacttttcccagaccc

SEQ ID NO: 113211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttttcccagacccatcag

SEQ ID NO: 113212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttttcccagacccatcaga

SEQ ID NO: 113213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcccagacccatcagagga

SEQ ID NO: 113214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcccagacccatcagaggaa

SEQ ID NO: 113215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccagacccatcagaggaat

SEQ ID NO: 113216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccagacccatcagaggaatc

SEQ ID NO: 113217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctatggcagctatagtctt

SEQ ID NO: 113218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggcagctatagtcttataa

SEQ ID NO: 113219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagtcttataaaatgtattt

SEQ ID NO: 113220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataaaatgtatttattaaaa

SEQ ID NO: 113221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaaatgtatttattaaaaa

SEQ ID NO: 113222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaaaaaataagacttaaa

SEQ ID NO: 113223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaaaaataagacttaaaa

SEQ ID NO: 113224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaataagacttaaaagtt

SEQ ID NO: 113225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaagttgaaattactcttt

SEQ ID NO: 113226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagttgaaattactctttg

SEQ ID NO: 113227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaattactctttggcccata

SEQ ID NO: 113228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctctttggcccataggctac

SEQ ID NO: 113229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttggcccataggctacaga

SEQ ID NO: 113230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggcccataggctacagaat

SEQ ID NO: 113231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcccataggctacagaatg

SEQ ID NO: 113232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcccataggctacagaatgg

SEQ ID NO: 113233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagaatggatagcgttagca

SEQ ID NO: 113234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaggcatgaaaataacatt

SEQ ID NO: 113235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgcccttgtacctctccgt

SEQ ID NO: 113236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtacctctccgttagagctc

SEQ ID NO: 113237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tacctctccgttagagctct

SEQ ID NO: 113238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tccgttagagctcttgagtg

SEQ ID NO: 113239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cgttagagctcttgagtgac

SEQ ID NO: 113240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagctcttgagtgaccaggc

SEQ ID NO: 113241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgagtgaccaggcacattg

SEQ ID NO: 113242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagtgaccaggcacattgtc

SEQ ID NO: 113243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtgaccaggcacattgtca

SEQ ID NO: 113244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaataggcagtgatatttt

SEQ ID NO: 113245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaaagaaatcttttttttt

SEQ ID NO: 113246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaagaaatctttttttttt

SEQ ID NO: 113247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaagaaatcttttttttttt

SEQ ID NO: 113248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttttttttcctgagctat

SEQ ID NO: 113249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttcctgagctata

SEQ ID NO: 113250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttcctgagctataa

SEQ ID NO: 113251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttcctgagctataag

SEQ ID NO: 113252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttcctgagctataagt

SEQ ID NO: 113253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttcctgagctataagta

SEQ ID NO: 113254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttcctgagctataagtat

SEQ ID NO: 113255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcctgagctataagtatc

SEQ ID NO: 113256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcctgagctataagtatca

SEQ ID NO: 113257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctgagctataagtatcaa

SEQ ID NO: 113258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgagctataagtatcaac

SEQ ID NO: 113259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgagctataagtatcaaca

SEQ ID NO: 113260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agctataagtatcaacactg

SEQ ID NO: 113261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taagtatcaacactgggcct

SEQ ID NO: 113262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcctaaaatatttagtgaa

SEQ ID NO: 113263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatatttagtgaaccatgc

SEQ ID NO: 113264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtgaaccatgctgtaaaca

SEQ ID NO: 113265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgaaccatgctgtaaacag

SEQ ID NO: 113266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaacagacgtgctgtcatc

SEQ ID NO: 113267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcatccaggctttgttgttc

SEQ ID NO: 113268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgttgttctatttatagagc

SEQ ID NO: 113269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttgttctatttatagagca

SEQ ID NO: 113270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgttctatttatagagcac

SEQ ID NO: 113271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttctatttatagagcacagg

SEQ ID NO: 113272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatttatagagcacaggcag

SEQ ID NO: 113273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttatagagcacaggcagag

SEQ ID NO: 113274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagagcacaggcagagtag

SEQ ID NO: 113275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagagcacaggcagagtaga

SEQ ID NO: 113276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtataattcttaagagatt

SEQ ID NO: 113277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtataattcttaagagattt

SEQ ID NO: 113278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaagagattttctgaatga

SEQ ID NO: 113279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagagattttctgaatgatt

SEQ ID NO: 113280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agagattttctgaatgatta

SEQ ID NO: 113281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgaatgattaaataatat

SEQ ID NO: 113282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaatgattaaataatata

SEQ ID NO: 113283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaatgattaaataatataa

SEQ ID NO: 113284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatgattaaataatataatt

SEQ ID NO: 113285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataatataattattattta

SEQ ID NO: 113286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatttaattttctgaataa

SEQ ID NO: 113287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaattttctgaataatta

SEQ ID NO: 113288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattttctgaataattaaat

SEQ ID NO: 113289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttctgaataattaaata

SEQ ID NO: 113290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgaataattaaataatat

SEQ ID NO: 113291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaataattaaataatata

SEQ ID NO: 113292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaataattaaataatatag

SEQ ID NO: 113293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aataattaaataatatagtt

SEQ ID NO: 113294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataatatagttattattta

SEQ ID NO: 113295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatttaattttctgaatag

SEQ ID NO: 113296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaattttctgaatagtaa

SEQ ID NO: 113297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattttctgaatagtaaaga

SEQ ID NO: 113298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttctgaatagtaaagaa

SEQ ID NO: 113299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgaatagtaaagaatata

SEQ ID NO: 113300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaatagtaaagaatataa

SEQ ID NO: 113301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaatagtaaagaatataat

SEQ ID NO: 113302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatagtaaagaatataatta

SEQ ID NO: 113303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaattttctgaatagtaa

SEQ ID NO: 113304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattttctgaatagtaaata

SEQ ID NO: 113305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttctgaatagtaaataa

SEQ ID NO: 113306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgaatagtaaataatata

SEQ ID NO: 113307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaatagtaaataatataa

SEQ ID NO: 113308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaatagtaaataatataat

SEQ ID NO: 113309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatagtaaataatataatta

SEQ ID NO: 113310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatgtaattttctgaatag

SEQ ID NO: 113311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtaattttctgaatagtaa

SEQ ID NO: 113312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgaatagtaaataatata

SEQ ID NO: 113313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaatagtaaataatataa

SEQ ID NO: 113314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaatagtaaataatataat

SEQ ID NO: 113315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatagtaaataatataatta

SEQ ID NO: 113316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatgtaattttctgaatag

SEQ ID NO: 113317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtaattttctgaatagtaa

SEQ ID NO: 113318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgaatagtaaataattat

SEQ ID NO: 113319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaatagtaaataattatt

SEQ ID NO: 113320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaatagtaaataattatta

SEQ ID NO: 113321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatagtaaataattattaat

SEQ ID NO: 113322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaatattctgaataattaa

SEQ ID NO: 113323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atattctgaataattaaata

SEQ ID NO: 113324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaataattaaataatataa

SEQ ID NO: 113325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aataattaaataatataatt

SEQ ID NO: 113326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataatataattctaagatt

SEQ ID NO: 113327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taagattttctgaacgataa

SEQ ID NO: 113328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agattttctgaacgataaat

SEQ ID NO: 113329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgaacgataaattagcat

SEQ ID NO: 113330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaacgataaattagcatt

SEQ ID NO: 113331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaacgataaattagcattt

SEQ ID NO: 113332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacgataaattagcatttgc

SEQ ID NO: 113333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcatttgcttcaatttaaag

SEQ ID NO: 113334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttcaatttaaagtcacca

SEQ ID NO: 113335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttcaatttaaagtcaccag

SEQ ID NO: 113336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caatttaaagtcaccagctg

SEQ ID NO: 113337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatttaaagtcaccagctgc

SEQ ID NO: 113338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagtcaccagctgcattat

SEQ ID NO: 113339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtcaccagctgcattatc

SEQ ID NO: 113340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cattatcccctaacaagaga

SEQ ID NO: 113341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcccctaacaagagagtcag

SEQ ID NO: 113342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acaagagagtcagcctgttc

SEQ ID NO: 113343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttcgttgaagctttgaagcc

SEQ ID NO: 113344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gttgaagctttgaagccaga

SEQ ID NO: 113345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagctttgaagccagacatt

SEQ ID NO: 113346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaagccagacattgacttc

SEQ ID NO: 113347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaagccagacattgacttct

SEQ ID NO: 113348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagccagacattgacttctc

SEQ ID NO: 113349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acttctcctttctagctata

SEQ ID NO: 113350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcctttctagctataatat

SEQ ID NO: 113351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctttctagctataatata

SEQ ID NO: 113352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctttctagctataatatatt

SEQ ID NO: 113353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctagctataatatattctt

SEQ ID NO: 113354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctagctataatatattcttc

SEQ ID NO: 113355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagctataatatattcttct

SEQ ID NO: 113356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctataatatattcttctag

SEQ ID NO: 113357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatatattcttctagtaga

SEQ ID NO: 113358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctagtagaaggctgttag

SEQ ID NO: 113359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctagtagaaggctgttagac

SEQ ID NO: 113360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagtagaaggctgttagacc

SEQ ID NO: 113361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtagaaggctgttagacctt

SEQ ID NO: 113362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttagaccttcattgcaaatc

SEQ ID NO: 113363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaccttcattgcaaatctgt

SEQ ID NO: 113364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattgcaaatctgttgttta

SEQ ID NO: 113365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attgcaaatctgttgtttaa

SEQ ID NO: 113366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaatctgttgtttaatgta

SEQ ID NO: 113367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgtttaatgtaaccactct

SEQ ID NO: 113368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttaatgtaaccactcttat

SEQ ID NO: 113369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatgtaaccactcttatcaa

SEQ ID NO: 113370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgtaaccactcttatcaat

SEQ ID NO: 113371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttatcaatgatcttagctag

SEQ ID NO: 113372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atcaatgatcttagctagat

SEQ ID NO: 113373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaatgatcttagctagatc

SEQ ID NO: 113374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agctagatcttctgaataac

SEQ ID NO: 113375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctagatcttctgaataact

SEQ ID NO: 113376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatcttctgaataacttgct

SEQ ID NO: 113377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgaataacttgctgcatct

SEQ ID NO: 113378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaataacttgctgcatctt

SEQ ID NO: 113379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aataacttgctgcatcttct

SEQ ID NO: 113380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctgcatcttctccattggc

SEQ ID NO: 113381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgcatcttctccattggca

SEQ ID NO: 113382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catcttctccattggcactt

SEQ ID NO: 113383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctccattggcacttgctgtt

SEQ ID NO: 113384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccattggcacttgctgttt

SEQ ID NO: 113385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cattggcacttgctgtttca

SEQ ID NO: 113386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcacttgctgtttcaccttg

SEQ ID NO: 113387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctgtttcaccttgcatttt

SEQ ID NO: 113388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgtttcaccttgcattttt

SEQ ID NO: 113389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttcaccttgcatttttatg

SEQ ID NO: 113390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caccttgcatttttatgtta

SEQ ID NO: 113391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accttgcatttttatgttat

SEQ ID NO: 113392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcatttttatgttatggcag

SEQ ID NO: 113393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catttttatgttatggcagt

SEQ ID NO: 113394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatgttatggcagtgactt

SEQ ID NO: 113395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgttatggcagtgacttc

SEQ ID NO: 113396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgttatggcagtgacttct

SEQ ID NO: 113397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgttatggcagtgacttctt

SEQ ID NO: 113398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggcagtgacttctttcctt

SEQ ID NO: 113399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttccttcaatctcatggg

SEQ ID NO: 113400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttccttcaatctcatgggg

SEQ ID NO: 113401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccttcaatctcatggggta

SEQ ID NO: 113402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttcaatctcatggggtac

SEQ ID NO: 113403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttcaatctcatggggtacc

SEQ ID NO: 113404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caatctcatggggtaccgtc

SEQ ID NO: 113405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatctcatggggtaccgtct

SEQ ID NO: 113406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atggggtaccgtctgccagc

SEQ ID NO: 113407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccagcttcaaaccttttttt

SEQ ID NO: 113408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaaccttttttttccagct

SEQ ID NO: 113409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaccttttttttccagctt

SEQ ID NO: 113410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttttccagcttcttcacc

SEQ ID NO: 113411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttccagcttcttcacct

SEQ ID NO: 113412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttccagcttcttcacctc

SEQ ID NO: 113413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttccagcttcttcacctct

SEQ ID NO: 113414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccagcttcttcacctctc

SEQ ID NO: 113415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccagcttcttcacctctca

SEQ ID NO: 113416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccagcttcttcacctctcag

SEQ ID NO: 113417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagcttcttcacctctcagc

SEQ ID NO: 113418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttcacctctcagccttcat

SEQ ID NO: 113419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcacctctcagccttcata

SEQ ID NO: 113420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacctctcagccttcataca

SEQ ID NO: 113421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acctctcagccttcatacaa

SEQ ID NO: 113422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcagccttcatacaattgga

SEQ ID NO: 113423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agccttcatacaattggagt

SEQ ID NO: 113424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catacaattggagttatggc

SEQ ID NO: 113425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atacaattggagttatggcc

SEQ ID NO: 113426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagttatggccttgctgtgg

SEQ ID NO: 113427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggccttgctgtggattagg

SEQ ID NO: 113428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctgtggattaggctttggc

SEQ ID NO: 113429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgtggattaggctttggct

SEQ ID NO: 113430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggattaggctttggcttaa

SEQ ID NO: 113431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggctttggcttaaggaaatg

SEQ ID NO: 113432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggcttaaggaaatgttgtg

SEQ ID NO: 113433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcttaaggaaatgttgtgg

SEQ ID NO: 113434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcttaaggaaatgttgtggc

SEQ ID NO: 113435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaggaaatgttgtggctggt

SEQ ID NO: 113436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggaaatgttgtggctggtt

SEQ ID NO: 113437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggctggttgatcttctatc

SEQ ID NO: 113438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttgatcttctatctagatc

SEQ ID NO: 113439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcttctatctagatcacta

SEQ ID NO: 113440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctatctagatcactaaaact

SEQ ID NO: 113441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatctagatcactaaaactt

SEQ ID NO: 113442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctagatcactaaaactttc

SEQ ID NO: 113443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatcactaaaactttctcta

SEQ ID NO: 113444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaactttctctatatttgca

SEQ ID NO: 113445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctctatatttgcaataagg

SEQ ID NO: 113446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctatatttgcaataaggc

SEQ ID NO: 113447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctatatttgcaataaggct

SEQ ID NO: 113448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatatttgcaataaggctgt

SEQ ID NO: 113449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatttgcaataaggctgttt

SEQ ID NO: 113450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaataaggctgttttgttt

SEQ ID NO: 113451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caataaggctgttttgtttt

SEQ ID NO: 113452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttgttttcttatcattca

SEQ ID NO: 113453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttttcttatcattcatgt

SEQ ID NO: 113454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttttcttatcattcatgtg

SEQ ID NO: 113455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttcttatcattcatgtgt

SEQ ID NO: 113456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttatcattcatgtgttca

SEQ ID NO: 113457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttatcattcatgtgttcac

SEQ ID NO: 113458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatcattcatgtgttcact

SEQ ID NO: 113459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atcattcatgtgttcactgg

SEQ ID NO: 113460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcattcatgtgttcactgga

SEQ ID NO: 113461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtgttcactggagtagca

SEQ ID NO: 113462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actggagtagcacatttgat

SEQ ID NO: 113463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagtagcacatttgatttcc

SEQ ID NO: 113464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatttccttcaagaatgttt

SEQ ID NO: 113465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atttccttcaagaatgtttc

SEQ ID NO: 113466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttcaagaatgtttccttt

SEQ ID NO: 113467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttcaagaatgtttcctttg

SEQ ID NO: 113468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caagaatgtttcctttgcat

SEQ ID NO: 113469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagaatgtttcctttgcatt

SEQ ID NO: 113470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctttgcattcacaacttgg

SEQ ID NO: 113471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttgcattcacaacttggc

SEQ ID NO: 113472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcattcacaacttggctaa

SEQ ID NO: 113473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcattcacaacttggctaag

SEQ ID NO: 113474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattcacaacttggctaagt

SEQ ID NO: 113475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaacttggctaagtactta

SEQ ID NO: 113476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggctaagtacttagtgcaag

SEQ ID NO: 113477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctaagtacttagtgcaaga

SEQ ID NO: 113478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtacttagtgcaagaggcc

SEQ ID NO: 113479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtgcaagaggcctagattt

SEQ ID NO: 113480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgcaagaggcctagatttt

SEQ ID NO: 113481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gattttggcctatcttggct

SEQ ID NO: 113482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggcctatcttggctttcaa

SEQ ID NO: 113483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcctatcttggctttcaac

SEQ ID NO: 113484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcctatcttggctttcaaca

SEQ ID NO: 113485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcttggctttcaacatgcct

SEQ ID NO: 113486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggctttcaacatgccttcct

SEQ ID NO: 113487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctttcaacatgccttcctc

SEQ ID NO: 113488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaacatgccttcctcacta

SEQ ID NO: 113489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caacatgccttcctcactaa

SEQ ID NO: 113490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacatgccttcctcactaag

SEQ ID NO: 113491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctcactaagcttaatcatt

SEQ ID NO: 113492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcactaagcttaatcattt

SEQ ID NO: 113493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actaagcttaatcatttcta

SEQ ID NO: 113494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agcttaatcatttctagctt

SEQ ID NO: 113495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatcatttctagcttctgat

SEQ ID NO: 113496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcatttctagcttctgatt

SEQ ID NO: 113497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctagcttctgatttaaagtg

SEQ ID NO: 113498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagcttctgatttaaagtga

SEQ ID NO: 113499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcttctgatttaaagtgaga

SEQ ID NO: 113500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgatttaaagtgagaaatg

SEQ ID NO: 113501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgatttaaagtgagaaatgc

SEQ ID NO: 113502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atttaaagtgagaaatgcgc

SEQ ID NO: 113503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagtgagaaatgcgcaatt

SEQ ID NO: 113504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtgagaaatgcgcaattc

SEQ ID NO: 113505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcctttacttgaacattag

SEQ ID NO: 113506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctttacttgaacattaggg

SEQ ID NO: 113507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttacttgaacattagggg

SEQ ID NO: 113508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacttgaacattaggggtgg

SEQ ID NO: 113509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttgaacattaggggtggg

SEQ ID NO: 113510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttgaacattaggggtggga

SEQ ID NO: 113511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaacattaggggtgggaatg

SEQ ID NO: 113512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacattaggggtgggaatgg

SEQ ID NO: 113513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggggtgggaatgggttacta

SEQ ID NO: 113514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaattggcctaattttaac

SEQ ID NO: 113515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attggcctaattttaacatc

SEQ ID NO: 113516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcctaattttaacatcgttg

SEQ ID NO: 113517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attttaacatcgttgtgtgt

SEQ ID NO: 113518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacatcgttgtgtgtcagg

SEQ ID NO: 113519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacatcgttgtgtgtcaggg

SEQ ID NO: 113520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatcgttgtgtgtcaggga

SEQ ID NO: 113521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtgtcagggaacagggaag

SEQ ID NO: 113522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggaaagggagagagatagg

SEQ ID NO: 113523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaacagaacacgtcacattt

SEQ ID NO: 113524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatgattgtttgctgtctta

SEQ ID NO: 113525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgattgtttgctgtcttat

SEQ ID NO: 113526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgctgtcttatgtggatg

SEQ ID NO: 113527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctgtcttatgtggatgtgg

SEQ ID NO: 113528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgtcttatgtggatgtggt

SEQ ID NO: 113529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcttatgtggatgtggttca

SEQ ID NO: 113530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgtggatgtggttcatagc

SEQ ID NO: 113531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtggatgtggttcatagca

SEQ ID NO: 113532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atagcaccccaaaacaatta

SEQ ID NO: 113533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccacagtaacaacaaagatc

SEQ ID NO: 113534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atcatagatcaccataacac

SEQ ID NO: 113535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataatggcaattacaaagt

SEQ ID NO: 113536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaagttgaaatattgtgag

SEQ ID NO: 113537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatattgtgagaattgcca

SEQ ID NO: 113538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgagaattgccaaagtgtga

SEQ ID NO: 113539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccaaagtgtgacacagatgc

SEQ ID NO: 113540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgaaaaaattacgctgaca

SEQ ID NO: 113541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaaattacgctgacagac

SEQ ID NO: 113542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cgctgacagacttgcttaat

SEQ ID NO: 113543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acagacttgcttaatgcagg

SEQ ID NO: 113544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcttaatgcagggttgccac

SEQ ID NO: 113545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttaatgcagggttgccaca

SEQ ID NO: 113546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatgcagggttgccacaaac

SEQ ID NO: 113547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgcagggttgccacaaacc

SEQ ID NO: 113548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccacaaaccttcaacttgta

SEQ ID NO: 113549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caacttgtaaagaatgcagt

SEQ ID NO: 113550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacttgtaaagaatgcagta

SEQ ID NO: 113551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaaagaatgcagtatcttg

SEQ ID NO: 113552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaagaatgcagtatcttga

SEQ ID NO: 113553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaagtgcaataaagtaaagc

SEQ ID NO: 113554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagtgcaataaagtaaagcc

SEQ ID NO: 113555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tattttgatggaaaccaaag

SEQ ID NO: 113556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgatggaaaccaaagttagg

SEQ ID NO: 113557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatggaaaccaaagttagga

SEQ ID NO: 113558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atggaaaccaaagttaggat

SEQ ID NO: 113559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggataaaggtttttaaagaa

SEQ ID NO: 113560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaagaatgtagtgaaaaa

SEQ ID NO: 113561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaagaatgtagtgaaaaat

SEQ ID NO: 113562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagaatgtagtgaaaaata

SEQ ID NO: 113563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagaatgtagtgaaaaataa

SEQ ID NO: 113564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catatacacattcaaaagta

SEQ ID NO: 113565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatacacattcaaaagtag

SEQ ID NO: 113566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaagtaggatgattctgaa

SEQ ID NO: 113567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaaaggtaaagagtaagtt

SEQ ID NO: 113568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaggtaaagagtaagttat

SEQ ID NO: 113569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgactcggcaattccactac

SEQ ID NO: 113570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggcaattccactacttggta

SEQ ID NO: 113571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cactacttggtacagactca

SEQ ID NO: 113572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttggtacagactcaaggga

SEQ ID NO: 113573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtacagactcaagggaatt

SEQ ID NO: 113574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtacagactcaagggaattt

SEQ ID NO: 113575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagggaatttaaaacatatg

SEQ ID NO: 113576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaacatatgtccacacaag

SEQ ID NO: 113577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaacatatgtccacacaaga

SEQ ID NO: 113578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatgaatgttcagcagcat

SEQ ID NO: 113579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catgaatgttcagcagcatt

SEQ ID NO: 113580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agcagcattattcatactag

SEQ ID NO: 113581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcatactagccaaaaagta

SEQ ID NO: 113582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atactagccaaaaagtaaac

SEQ ID NO: 113583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gccaaaaagtaaacacaacc

SEQ ID NO: 113584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attactcaccaatgaataaa

SEQ ID NO: 113585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcaccaatgaataaatgga

SEQ ID NO: 113586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
accaatgaataaatggataa

SEQ ID NO: 113587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaacactgaattagtattta

SEQ ID NO: 113588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aattagtatttagcaataaa

SEQ ID NO: 113589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtatttagcaataaaaacaa

SEQ ID NO: 113590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcaataaaaacaaatgaag

SEQ ID NO: 113591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaataaaaacaaatgaagt

SEQ ID NO: 113592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caacatggatgtgatgaaaa

SEQ ID NO: 113593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catcttatgaaatgtccaga

SEQ ID NO: 113594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgaaatgtccagaataggc

SEQ ID NO: 113595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgaaatgtccagaataggca

SEQ ID NO: 113596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgtcagaggctgggtgta

SEQ ID NO: 113597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtcagaggctgggtgtaa

SEQ ID NO: 113598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtcagaggctgggtgtaat

SEQ ID NO: 113599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcagaggctgggtgtaata

SEQ ID NO: 113600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcagaggctgggtgtaatag

SEQ ID NO: 113601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtgtaataggaagtgatta

SEQ ID NO: 113602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgatggttatgtggttaat

SEQ ID NO: 113603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atggttatgtggttaatggt

SEQ ID NO: 113604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtggttaatggttaaagag

SEQ ID NO: 113605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atggttaaagagtatggggc

SEQ ID NO: 113606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagagtatggggcttctttt

SEQ ID NO: 113607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttttggggtgataaaaata

SEQ ID NO: 113608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttggggtgataaaaatat

SEQ ID NO: 113609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttggggtgataaaaatattc

SEQ ID NO: 113610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggggtgataaaaatattct

SEQ ID NO: 113611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggggtgataaaaatattcta

SEQ ID NO: 113612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggtgataaaaatattctaa

SEQ ID NO: 113613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaaactacataatgatgat

SEQ ID NO: 113614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaactacataatgatgattg

SEQ ID NO: 113615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cataatgatgattgttgcat

SEQ ID NO: 113616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgcatacctttgtgaacat

SEQ ID NO: 113617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catacctttgtgaacatact

SEQ ID NO: 113618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtgaacatactaaaaacca

SEQ ID NO: 113619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgaacatactaaaaaccac

SEQ ID NO: 113620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaacatactaaaaaccact

SEQ ID NO: 113621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaaccactgagtgatacac

SEQ ID NO: 113622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtgatacactttaaaatgg

SEQ ID NO: 113623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaaatggtgattttttatg

SEQ ID NO: 113624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatggtgattttttatgg

SEQ ID NO: 113625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatggtgattttttatggt

SEQ ID NO: 113626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttatggtgtgtaaattata

SEQ ID NO: 113627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatggtgtgtaaattatat

SEQ ID NO: 113628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatggtgtgtaaattatatc

SEQ ID NO: 113629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atggtgtgtaaattatatct

SEQ ID NO: 113630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggtgtgtaaattatatctt

SEQ ID NO: 113631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatcttaataaaactactat

SEQ ID NO: 113632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aataaaactactatgaatat

SEQ ID NO: 113633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataaaactactatgaatatg

SEQ ID NO: 113634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctatgaatatgcattaagaa

SEQ ID NO: 113635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgaatatgcattaagaattt

SEQ ID NO: 113636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaattttgaatcctaaaat

SEQ ID NO: 113637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaatcctaaaatatgtgaa

SEQ ID NO: 113638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaatcctaaaatatgtgaaa

SEQ ID NO: 113639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatcctaaaatatgtgaaaa

SEQ ID NO: 113640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatatgtgaaaattgtcct

SEQ ID NO: 113641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcctcagaataggaagagat

SEQ ID NO: 113642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaataggaagagatttagt

SEQ ID NO: 113643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtaaaaaggaaacaaatca

SEQ ID NO: 113644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtaaaaaggaaacaaatcaa

SEQ ID NO: 113645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccacttgtgctttggagatt

SEQ ID NO: 113646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgctttggagattcctcaa

SEQ ID NO: 113647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgctttggagattcctcaac

SEQ ID NO: 113648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggagattcctcaacacttt

SEQ ID NO: 113649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggagattcctcaacactttt

SEQ ID NO: 113650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagattcctcaacacttttg

SEQ ID NO: 113651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcaacacttttggaaatca

SEQ ID NO: 113652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aacacttttggaaatcataa

SEQ ID NO: 113653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttggaaatcataaaggtgag

SEQ ID NO: 113654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggaaatcataaaggtgaga

SEQ ID NO: 113655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaaatcataaaggtgagaa

SEQ ID NO: 113656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaatcataaaggtgagaag

SEQ ID NO: 113657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcctcactagactttcagtg

SEQ ID NO: 113658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctcactagactttcagtgt

SEQ ID NO: 113659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actagactttcagtgtagac

SEQ ID NO: 113660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gactttcagtgtagacatac

SEQ ID NO: 113661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcagtgtagacatactgtgg

SEQ ID NO: 113662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagtgtagacatactgtggc

SEQ ID NO: 113663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtgtagacatactgtggct

SEQ ID NO: 113664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggctcttgaagaaaagttg

SEQ ID NO: 113665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgaagaaaagttggcttga

SEQ ID NO: 113666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaagaaaagttggcttgaat

SEQ ID NO: 113667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagaaaagttggcttgaata

SEQ ID NO: 113668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcttgaataactggtgtttt

SEQ ID NO: 113669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaataactggtgtttttgta

SEQ ID NO: 113670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aataactggtgtttttgtag

SEQ ID NO: 113671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtgtttttgtagattctaca

SEQ ID NO: 113672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtagattctacattcaac

SEQ ID NO: 113673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtagattctacattcaact

SEQ ID NO: 113674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtagattctacattcaactg

SEQ ID NO: 113675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagattctacattcaactgg

SEQ ID NO: 113676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacattcaactggagggtac

SEQ ID NO: 113677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cattcaactggagggtacca

SEQ ID NO: 113678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aactggagggtaccatctct

SEQ ID NO: 113679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagggtaccatctctttcaa

SEQ ID NO: 113680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttcaagaattatttgacag

SEQ ID NO: 113681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaagaattatttgacagaa

SEQ ID NO: 113682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caagaattatttgacagaaa

SEQ ID NO: 113683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagaattatttgacagaaat

SEQ ID NO: 113684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgacagaaatctaggtac

SEQ ID NO: 113685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacagaaatctaggtacaaa

SEQ ID NO: 113686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acagaaatctaggtacaaag

SEQ ID NO: 113687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtacaaagatgttgtgaac

SEQ ID NO: 113688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaactcagatgtccattac

SEQ ID NO: 113689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agatgtccattaccagtttg

SEQ ID NO: 113690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccagtttgattcttccaata

SEQ ID NO: 113691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gattcttccaatattcctat

SEQ ID NO: 113692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attcttccaatattcctatt

SEQ ID NO: 113693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttccaatattcctattctcc

SEQ ID NO: 113694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaatattcctattctcctc

SEQ ID NO: 113695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caatattcctattctcctct

SEQ ID NO: 113696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctattctcctctgtctctgt

SEQ ID NO: 113697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttctcctctgtctctgtctc

SEQ ID NO: 113698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctctgtctctgtctcccc

SEQ ID NO: 113699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctctgtctctgtctccccca

SEQ ID NO: 113700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtctctgtctcccccaacc

SEQ ID NO: 113701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctctgtctcccccaacccc

SEQ ID NO: 113702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtctcccccaacccccatg

SEQ ID NO: 113703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctcccccaacccccatgca

SEQ ID NO: 113704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccccaacccccatgcacatg

SEQ ID NO: 113705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aacacagctccagaatgact

SEQ ID NO: 113706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagaatgactaaagtatatg

SEQ ID NO: 113707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtatatgaaaaaagcaga

SEQ ID NO: 113708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtggtaccatgcatgggcaa

SEQ ID NO: 113709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctgatcaagctaaattaa

SEQ ID NO: 113710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctgatcaagctaaattaaa

SEQ ID NO: 113711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atcaagctaaattaaaggaa

SEQ ID NO: 113712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattaaaggaagacactaag

SEQ ID NO: 113713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaggaagacactaagcacct

SEQ ID NO: 113714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agcacctgcttaacatcatg

SEQ ID NO: 113715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttaacatcatgatctgtga

SEQ ID NO: 113716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacatcatgatctgtgaaat

SEQ ID NO: 113717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatcatgatctgtgaaatg

SEQ ID NO: 113718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgaaatggaagttgaagaga

SEQ ID NO: 113719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagagaccttgatcagattt

SEQ ID NO: 113720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatcagatttcatcatcatc

SEQ ID NO: 113721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcagatttcatcatcatcc

SEQ ID NO: 113722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catcatcatcctctagtttg

SEQ ID NO: 113723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcatcatcctctagtttgg

SEQ ID NO: 113724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagtttggagaggtgaaact

SEQ ID NO: 113725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtttggagaggtgaaacttc

SEQ ID NO: 113726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggagaggtgaaacttccttt

SEQ ID NO: 113727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagaggtgaaacttcctttc

SEQ ID NO: 113728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctttcattttactaatttt

SEQ ID NO: 113729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttcattttactaatttta

SEQ ID NO: 113730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcattttactaattttatag

SEQ ID NO: 113731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattttactaattttatagc

SEQ ID NO: 113732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attttactaattttatagct

SEQ ID NO: 113733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tactaattttatagctttga

SEQ ID NO: 113734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actaattttatagctttgaa

SEQ ID NO: 113735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaattttatagctttgaag

SEQ ID NO: 113736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attttatagctttgaagaag

SEQ ID NO: 113737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatagctttgaagaagagca

SEQ ID NO: 113738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagctttgaagaagagcag

SEQ ID NO: 113739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagctttgaagaagagcagc

SEQ ID NO: 113740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaagaagagcagctttagt

SEQ ID NO: 113741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaagaagagcagctttagtt

SEQ ID NO: 113742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagaagagcagctttagttg

SEQ ID NO: 113743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagttggcatctgagtttgc

SEQ ID NO: 113744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agttggcatctgagtttgct

SEQ ID NO: 113745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttggcatctgagtttgctt

SEQ ID NO: 113746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcatctgagtttgcttggaa

SEQ ID NO: 113747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtttgcttggaagttattg

SEQ ID NO: 113748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttggaagttattgtacca

SEQ ID NO: 113749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttggaagttattgtaccag

SEQ ID NO: 113750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaagttattgtaccaggcc

SEQ ID NO: 113751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaagttattgtaccaggcca

SEQ ID NO: 113752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgtaccaggccagtggggt

SEQ ID NO: 113753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taccaggccagtggggtggc

SEQ ID NO: 113754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acagggttacagagggcaac

SEQ ID NO: 113755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagagggcaacataagtaaa

SEQ ID NO: 113756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acacttcaccaacacacaca

SEQ ID NO: 113757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caccaacacacacaaagaag

SEQ ID NO: 113758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accaacacacacaaagaaga

SEQ ID NO: 113759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtgtgactacaacttcttt

SEQ ID NO: 113760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caacttctttcctcttccct

SEQ ID NO: 113761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttcctcttcccttagtct

SEQ ID NO: 113762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcctcttcccttagtctt

SEQ ID NO: 113763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcctcttcccttagtcttct

SEQ ID NO: 113764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctcttcccttagtcttctg

SEQ ID NO: 113765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcttcccttagtcttctgg

SEQ ID NO: 113766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcccttagtcttctggata

SEQ ID NO: 113767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccttagtcttctggataaa

SEQ ID NO: 113768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttagtcttctggataaac

SEQ ID NO: 113769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtcttctggataaacaggc

SEQ ID NO: 113770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtcttctggataaacaggcc

SEQ ID NO: 113771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctggataaacaggccacagg

SEQ ID NO: 113772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggataaacaggccacagga

SEQ ID NO: 113773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gataaacaggccacaggagt

SEQ ID NO: 113774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattagtcaggcatttagt

SEQ ID NO: 113775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattagtcaggcatttagtt

SEQ ID NO: 113776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attagtcaggcatttagttt

SEQ ID NO: 113777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtcaggcatttagtttaaga

SEQ ID NO: 113778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtttaagatttgagatttc

SEQ ID NO: 113779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtttaagatttgagatttct

SEQ ID NO: 113780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagatttgagatttctggtg

SEQ ID NO: 113781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agatttgagatttctggtgg

SEQ ID NO: 113782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagatttctggtggagtaaa

SEQ ID NO: 113783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agatttctggtggagtaaat

SEQ ID NO: 113784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctggtggagtaaatatttaa

SEQ ID NO: 113785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggtggagtaaatatttaaa

SEQ ID NO: 113786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtggagtaaatatttaaatg

SEQ ID NO: 113787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatggaaaaataaagctca

SEQ ID NO: 113788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatggaaaaataaagctcaa

SEQ ID NO: 113789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaacattctaataaaagtga

SEQ ID NO: 113790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taataaaagtgaaaatgaat

SEQ ID NO: 113791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ataaaagtgaaaatgaatac

SEQ ID NO: 113792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttaatgtgagagtagaga

SEQ ID NO: 113793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaatgtgagagtagagag

SEQ ID NO: 113794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatgtgagagtagagaggac

SEQ ID NO: 113795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgtgagagtagagaggact

SEQ ID NO: 113796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaaagcattacaccaaagg

SEQ ID NO: 113797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaagcattacaccaaaggc

SEQ ID NO: 113798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caccaaaggcaaaatcgaaa

SEQ ID NO: 113799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatttaatctcataacaatg

SEQ ID NO: 113800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatctcataacaatgaaggt

SEQ ID NO: 113801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atctcataacaatgaaggtt

SEQ ID NO: 113802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataacaatgaaggtttttaa

SEQ ID NO: 113803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaagtggaaggcatcca

SEQ ID NO: 113804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaagtggaaggcatccac

SEQ ID NO: 113805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaagtggaaggcatccaca

SEQ ID NO: 113806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagtggaaggcatccacaa

SEQ ID NO: 113807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcctttaatgaataaagat

SEQ ID NO: 113808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctttaatgaataaagata

SEQ ID NO: 113809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctttaatgaataaagatat

SEQ ID NO: 113810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttaatgaataaagatatt

SEQ ID NO: 113811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taatgaataaagatattaat

SEQ ID NO: 113812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatgaataaagatattaata

SEQ ID NO: 113813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgaataaagatattaatat

SEQ ID NO: 113814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatatctcataaaatttag

SEQ ID NO: 113815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataaaatttagtaaaaaaca

SEQ ID NO: 113816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtaaaaaacataattatct

SEQ ID NO: 113817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtaaaaaacataattatcta

SEQ ID NO: 113818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctaaaaatacaaatggtta

SEQ ID NO: 113819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaatacaaatggttaataa

SEQ ID NO: 113820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataaacacttgtaaccatgt

SEQ ID NO: 113821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaaccatgtcaaacctcac

SEQ ID NO: 113822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaccatgtcaaacctcact

SEQ ID NO: 113823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actagtaatcaaagaaacaa

SEQ ID NO: 113824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtaatcaaagaaacaaatat

SEQ ID NO: 113825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaataaacatggggaaccaa

SEQ ID NO: 113826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcctattaatcattagcaa

SEQ ID NO: 113827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcctattaatcattagcaaa

SEQ ID NO: 113828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttaatcattagcaaagattt

SEQ ID NO: 113829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcattagcaaagattttaa

SEQ ID NO: 113830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaaagattttaacaaaagt

SEQ ID NO: 113831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacaaaagtaatagtgata

SEQ ID NO: 113832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacaaaagtaatagtgatat

SEQ ID NO: 113833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaaaagtaatagtgatatt

SEQ ID NO: 113834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagaggttataggggaaatc

SEQ ID NO: 113835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taggggaaatcagtgttgcc

SEQ ID NO: 113836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctgtctggatgaaagtaat

SEQ ID NO: 113837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctggatgaaagtaataaat

SEQ ID NO: 113838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatgaaagtaataaataatg

SEQ ID NO: 113839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctgggtgcggtggctcacg

SEQ ID NO: 113840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtgcggtggctcacgccta

SEQ ID NO: 113841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acgcctataatcccagaact

SEQ ID NO: 113842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatcccagaactttgggag

SEQ ID NO: 113843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgggaggcccaggcaggcag

SEQ ID NO: 113844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggaggcccaggcaggcaga

SEQ ID NO: 113845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaggcccaggcaggcagat

SEQ ID NO: 113846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcgaacactgtgaaaccctg

SEQ ID NO: 113847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgaaaccctgtctctactaa

SEQ ID NO: 113848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctctactaaaagtacaaaa

SEQ ID NO: 113849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tactaaaagtacaaaaaaat

SEQ ID NO: 113850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaaaagtacaaaaaaatta

SEQ ID NO: 113851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaagtacaaaaaaattagcc

SEQ ID NO: 113852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccaggcatgttggcaggcg

SEQ ID NO: 113853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcaggcgcctatagtcccag

SEQ ID NO: 113854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagtcccagctgctcgggag

SEQ ID NO: 113855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctcgggaggctgaggcagag

SEQ ID NO: 113856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gggaggctgaggcagagaat

SEQ ID NO: 113857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggcagagaatggcgtgaac

SEQ ID NO: 113858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcagtgagccaagatcgtgc

SEQ ID NO: 113859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagtgagccaagatcgtgcc

SEQ ID NO: 113860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cactccagcctgggcaatag

SEQ ID NO: 113861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagcctgggcaatagagcga

SEQ ID NO: 113862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcaatagagcgagactccg

SEQ ID NO: 113863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cgtctcaaataaataaataa

SEQ ID NO: 113864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaataaataaataaagtgta

SEQ ID NO: 113865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttgagggtaattttgtaat

SEQ ID NO: 113866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgagggtaattttgtaata

SEQ ID NO: 113867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgagggtaattttgtaatat

SEQ ID NO: 113868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagggtaattttgtaatatc

SEQ ID NO: 113869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agggtaattttgtaatatct

SEQ ID NO: 113870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaatatctatcaaaagcc

SEQ ID NO: 113871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaatatctatcaaaagcct

SEQ ID NO: 113872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatatctatcaaaagcctt

SEQ ID NO: 113873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaaaagccttaaacacgtg

SEQ ID NO: 113874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaacacgtgaattcgtttat

SEQ ID NO: 113875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacacgtgaattcgtttata

SEQ ID NO: 113876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gtttatattgccaaataatt

SEQ ID NO: 113877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atattgccaaataattttcc

SEQ ID NO: 113878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattgccaaataattttcct

SEQ ID NO: 113879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccaaataattttccttctag

SEQ ID NO: 113880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccttctaggaatttattca

SEQ ID NO: 113881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttctaggaatttattcaa

SEQ ID NO: 113882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttctaggaatttattcaaa

SEQ ID NO: 113883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaggaatttattcaaagac

SEQ ID NO: 113884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taggaatttattcaaagaca

SEQ ID NO: 113885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggaatttattcaaagacagt

SEQ ID NO: 113886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attcaaagacagtaatctca

SEQ ID NO: 113887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcaaagacagtaatctcag

SEQ ID NO: 113888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaagacagtaatctcaggtg

SEQ ID NO: 113889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggtgtcctctaacatgtat

SEQ ID NO: 113890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taacatgtataaatatattt

SEQ ID NO: 113891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acatgtataaatatatttac

SEQ ID NO: 113892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actacaatatttttataata

SEQ ID NO: 113893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctacaatatttttataatat

SEQ ID NO: 113894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caatatttttataatattga

SEQ ID NO: 113895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttataatattgaaaaattat

SEQ ID NO: 113896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tataatattgaaaaattata

SEQ ID NO: 113897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataatattgaaaaattataa

SEQ ID NO: 113898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatattgaaaaattataat

SEQ ID NO: 113899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaattataatcaatccaa

SEQ ID NO: 113900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatcaatccaaaatcctaa

SEQ ID NO: 113901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acagtaagggttacactaaa

SEQ ID NO: 113902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cactaaatgaagtaatgaat

SEQ ID NO: 113903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatgaagtaatgaatgtata

SEQ ID NO: 113904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaaagagagcgttcaaaga

SEQ ID NO: 113905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaagagagcgttcaaagac

SEQ ID NO: 113906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaagagagcgttcaaagact

SEQ ID NO: 113907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaagactatttaatgaatta

SEQ ID NO: 113908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttaatgaattaaatgaatt

SEQ ID NO: 113909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatgaattaaatgaattata

SEQ ID NO: 113910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgaattaaatgaattataa

SEQ ID NO: 113911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgaattataaaaatataa

SEQ ID NO: 113912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaaaatataatgcataata

SEQ ID NO: 113913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacacacagatagatgtaaa

SEQ ID NO: 113914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataataatttttaaaatgat

SEQ ID NO: 113915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaatgatatttaattta

SEQ ID NO: 113916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaatgatatttaatttaa

SEQ ID NO: 113917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatgatatttaatttaaa

SEQ ID NO: 113918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgatatttaatttaaat

SEQ ID NO: 113919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttaaatacacaatgcat

SEQ ID NO: 113920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttaaatacacaatgcatt

SEQ ID NO: 113921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatacacaatgcatttaac

SEQ ID NO: 113922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatacacaatgcatttaaca

SEQ ID NO: 113923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacaaagtttagccctagtt

SEQ ID NO: 113924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaaagtttagccctagtta

SEQ ID NO: 113925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agccctagttaagagattat

SEQ ID NO: 113926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccctagttaagagattatg

SEQ ID NO: 113927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gttaagagattatggattat

SEQ ID NO: 113928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agagattatggattattttt

SEQ ID NO: 113929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggattatttttatgtcttt

SEQ ID NO: 113930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttatgtctttatacttt

SEQ ID NO: 113931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatgtctttatactttact

SEQ ID NO: 113932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgtctttatactttactt

SEQ ID NO: 113933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgtctttatactttacttt

SEQ ID NO: 113934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtctttatactttactttt

SEQ ID NO: 113935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatactttacttttcaaatt

SEQ ID NO: 113936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atactttacttttcaaattt

SEQ ID NO: 113937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactttacttttcaaatttg

SEQ ID NO: 113938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacttttcaaatttgtacaa

SEQ ID NO: 113939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttttcaaatttgtacaac

SEQ ID NO: 113940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttttcaaatttgtacaacg

SEQ ID NO: 113941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcaaatttgtacaacgaaa

SEQ ID NO: 113942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaatttgtacaacgaaaa

SEQ ID NO: 113943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaatttgtacaacgaaaat

SEQ ID NO: 113944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaatttgtacaacgaaaatg

SEQ ID NO: 113945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtacaacgaaaatgtcatgt

SEQ ID NO: 113946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tacaacgaaaatgtcatgtt

SEQ ID NO: 113947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctatccagaagaaagaaa

SEQ ID NO: 113948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctatccagaagaaagaaaa

SEQ ID NO: 113949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatccagaagaaagaaaat

SEQ ID NO: 113950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatccagaagaaagaaaata

SEQ ID NO: 113951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tccagaagaaagaaaatata

SEQ ID NO: 113952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaaaaaaatcatttaaaat

SEQ ID NO: 113953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaaaaatcatttaaaatt

SEQ ID NO: 113954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaaaatcatttaaaatta

SEQ ID NO: 113955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaattatttgacctaattt

SEQ ID NO: 113956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattatttgacctaatttt

SEQ ID NO: 113957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgacctaattttatatag

SEQ ID NO: 113958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacctaattttatatagtca

SEQ ID NO: 113959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acctaattttatatagtcaa

SEQ ID NO: 113960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attttatatagtcaatgaaa

SEQ ID NO: 113961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatatagtcaatgaaatcaa

SEQ ID NO: 113962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatagtcaatgaaatcaat

SEQ ID NO: 113963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatagtcaatgaaatcaatc

SEQ ID NO: 113964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attcttgtcatgtttaattt

SEQ ID NO: 113965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcttgtcatgtttaattta

SEQ ID NO: 113966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgtcatgtttaatttacaa

SEQ ID NO: 113967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtcatgtttaatttacaatt

SEQ ID NO: 113968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcatgtttaatttacaattt

SEQ ID NO: 113969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttacaattttgaaaaat

SEQ ID NO: 113970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttacaattttgaaaaata

SEQ ID NO: 113971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaattttgaaaaatatatt

SEQ ID NO: 113972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caattttgaaaaatatattg

SEQ ID NO: 113973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaaaaatatattgctacat

SEQ ID NO: 113974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaaatatattgctacatt

SEQ ID NO: 113975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaatatattgctacattt

SEQ ID NO: 113976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctacatttccacttttatta

SEQ ID NO: 113977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catttccacttttattaaca

SEQ ID NO: 113978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccacttttattaacattact

SEQ ID NO: 113979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacttttattaacattacta

SEQ ID NO: 113980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttattaacattactatgatt

SEQ ID NO: 113981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattaacattactatgattg

SEQ ID NO: 113982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaacattactatgattgt

SEQ ID NO: 113983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaacattactatgattgta

SEQ ID NO: 113984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acattactatgattgtatct

SEQ ID NO: 113985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctatgattgtatcttcttta

SEQ ID NO: 113986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgattgtatcttctttagaa

SEQ ID NO: 113987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatcttctttagaatgaaat

SEQ ID NO: 113988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttagaatgaaatcccaat

SEQ ID NO: 113989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttagaatgaaatcccaatg

SEQ ID NO: 113990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagaatgaaatcccaatgtt

SEQ ID NO: 113991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaatgaaatcccaatgttg

SEQ ID NO: 113992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatgaaatcccaatgttgc

SEQ ID NO: 113993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catataaaggcagtactttt

SEQ ID NO: 113994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgttttctcattactatct

SEQ ID NO: 113995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttttctcattactatctt

SEQ ID NO: 113996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttttctcattactatctta

SEQ ID NO: 113997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttctcattactatcttac

SEQ ID NO: 113998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctcattactatcttaccca

SEQ ID NO: 113999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcattactatcttacccac

SEQ ID NO: 114000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcattactatcttacccact

SEQ ID NO: 114001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attactatcttacccactca

SEQ ID NO: 114002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctatcttacccactcaccat

SEQ ID NO: 114003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcttacccactcaccattaa

SEQ ID NO: 114004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acccactcaccattaatctc

SEQ ID NO: 114005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccactcaccattaatctca

SEQ ID NO: 114006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
accattaatctcatattaga

SEQ ID NO: 114007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atctcatattagagaatact

SEQ ID NO: 114008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atattagagaatacttaggc

SEQ ID NO: 114009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagaatacttaggcaactac

SEQ ID NO: 114010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aggcaactactaaaattaaa

SEQ ID NO: 114011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggcaactactaaaattaaaa

SEQ ID NO: 114012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaaaattaaaaaatgaatg

SEQ ID NO: 114013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaattaaaaaatgaatgtgt

SEQ ID NO: 114014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaatgaatgtgttattct

SEQ ID NO: 114015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcttgtatctaagatttcc

SEQ ID NO: 114016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgtatctaagatttcctat

SEQ ID NO: 114017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtatctaagatttcctatag

SEQ ID NO: 114018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatctaagatttcctatagt

SEQ ID NO: 114019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agatttcctatagttaaaat

SEQ ID NO: 114020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctatagttaaaatcaatat

SEQ ID NO: 114021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctatagttaaaatcaatatg

SEQ ID NO: 114022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagttaaaatcaatatggaa

SEQ ID NO: 114023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatcaatatggaaatattt

SEQ ID NO: 114024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attctgaactctttcttatt

SEQ ID NO: 114025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctgaactctttcttattt

SEQ ID NO: 114026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaactctttcttattttct

SEQ ID NO: 114027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aactctttcttattttctat

SEQ ID NO: 114028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttcttattttctatgtatg

SEQ ID NO: 114029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttattttctatgtatgca

SEQ ID NO: 114030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttattttctatgtatgcag

SEQ ID NO: 114031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttattttctatgtatgcaga

SEQ ID NO: 114032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attttctatgtatgcagaca

SEQ ID NO: 114033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttctatgtatgcagacac

SEQ ID NO: 114034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctatgtatgcagacacaca

SEQ ID NO: 114035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatgtatgcagacacacac

SEQ ID NO: 114036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatgtatgcagacacacaca

SEQ ID NO: 114037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtatgcagacacacacata

SEQ ID NO: 114038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatctatgcttatccatcta

SEQ ID NO: 114039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctatgcttatccatctat

SEQ ID NO: 114040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctatgcttatccatctatg

SEQ ID NO: 114041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgcttatccatctatggatc

SEQ ID NO: 114042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atccatctatggatctatgt

SEQ ID NO: 114043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccatctatggatctatgtc

SEQ ID NO: 114044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggatctatgtctgtccaaa

SEQ ID NO: 114045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtctgtccaaatatcatat

SEQ ID NO: 114046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tccaaatatcatatcatgta

SEQ ID NO: 114047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtctatctagcatctatttt

SEQ ID NO: 114048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctatctagcatctattttt

SEQ ID NO: 114049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctagcatctatttttcttc

SEQ ID NO: 114050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcatctatttttcttcacac

SEQ ID NO: 114051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttttcttcacacatctttc

SEQ ID NO: 114052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttcacacatctttccag

SEQ ID NO: 114053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttcacacatctttccagt

SEQ ID NO: 114054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcacacatctttccagtc

SEQ ID NO: 114055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcacacatctttccagtca

SEQ ID NO: 114056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacacatctttccagtcaaa

SEQ ID NO: 114057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acacatctttccagtcaaag

SEQ ID NO: 114058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccagtcaaagcaatgtcag

SEQ ID NO: 114059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccagtcaaagcaatgtcagc

SEQ ID NO: 114060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagtcaaagcaatgtcagct

SEQ ID NO: 114061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccagttcatgaaaatggtct

SEQ ID NO: 114062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgaaaatggtcttatccca

SEQ ID NO: 114063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atcccatgtgtttatcacac

SEQ ID NO: 114064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcccatgtgtttatcacact

SEQ ID NO: 114065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcacactctctggccttca

SEQ ID NO: 114066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcacactctctggccttcaa

SEQ ID NO: 114067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctggccttcaaatttccat

SEQ ID NO: 114068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tggccttcaaatttccattg

SEQ ID NO: 114069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gccttcaaatttccattgca

SEQ ID NO: 114070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaatttccattgcagtaaa

SEQ ID NO: 114071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaatttccattgcagtaaaa

SEQ ID NO: 114072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccattgcagtaaaaacaaag

SEQ ID NO: 114073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattgcagtaaaaacaaaga

SEQ ID NO: 114074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagtaaaaacaaagatgtac

SEQ ID NO: 114075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gataatatcactaaaaacca

SEQ ID NO: 114076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaaccagaggaagacaaaa

SEQ ID NO: 114077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcataaatcataagattacc

SEQ ID NO: 114078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccctagtgaggagatcaaag

SEQ ID NO: 114079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtgaggagatcaaagcagaa

SEQ ID NO: 114080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagtctagaacactcatctg

SEQ ID NO: 114081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaacactcatctgagaatgt

SEQ ID NO: 114082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atctgagaatgttagaattt

SEQ ID NO: 114083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaatgttagaatttctttc

SEQ ID NO: 114084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatttctttctagcagaga

SEQ ID NO: 114085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctagcagagaagtcac

SEQ ID NO: 114086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctagcagagaagtcaca

SEQ ID NO: 114087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctagcagagaagtcacaga

SEQ ID NO: 114088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctagcagagaagtcacagat

SEQ ID NO: 114089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagcagagaagtcacagatt

SEQ ID NO: 114090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcagagaagtcacagatttc

SEQ ID NO: 114091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatggcaaatatgtgatgt

SEQ ID NO: 114092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatggcaaatatgtgatgta

SEQ ID NO: 114093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggcaaatatgtgatgtaga

SEQ ID NO: 114094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attaatccatggattattta

SEQ ID NO: 114095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atccatggattatttattca

SEQ ID NO: 114096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttattcaataatgttgcag

SEQ ID NO: 114097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attcaataatgttgcagaaa

SEQ ID NO: 114098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcaataatgttgcagaaaa

SEQ ID NO: 114099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aataatgttgcagaaaacat

SEQ ID NO: 114100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagaaaacattgtcccactt

SEQ ID NO: 114101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcccacttccctctctatgt

SEQ ID NO: 114102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctctctatgttaaatatg

SEQ ID NO: 114103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctctctatgttaaatatgt

SEQ ID NO: 114104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctatgttaaatatgtagca

SEQ ID NO: 114105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatgttaaatatgtagcaga

SEQ ID NO: 114106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgttaaatatgtagcagagt

SEQ ID NO: 114107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatatgtagcagagtggttt

SEQ ID NO: 114108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctccaagctatcaccaaa

SEQ ID NO: 114109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctccaagctatcaccaaaa

SEQ ID NO: 114110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caagctatcaccaaaaggat

SEQ ID NO: 114111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaccaaaaggataatatct

SEQ ID NO: 114112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cattaattaaggtaggactc

SEQ ID NO: 114113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attaaggtaggactcctagg

SEQ ID NO: 114114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggtaggactcctagggtat

SEQ ID NO: 114115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctagggtatccatgtccatt

SEQ ID NO: 114116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gggtatccatgtccatttta

SEQ ID NO: 114117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagctagaaccagggtggag

SEQ ID NO: 114118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agctagaaccagggtggagt

SEQ ID NO: 114119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctagaaccagggtggagtc

SEQ ID NO: 114120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaccagggtggagtcgagg

SEQ ID NO: 114121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccttatctactcctcatcca

SEQ ID NO: 114122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atctactcctcatccataca

SEQ ID NO: 114123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctactcctcatccatacat

SEQ ID NO: 114124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcctcatccatacatccta

SEQ ID NO: 114125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcatccatacatcctaaaa

SEQ ID NO: 114126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atccatacatcctaaaatgt

SEQ ID NO: 114127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatgtagcctgcctgtcag

SEQ ID NO: 114128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctgtcagtacaccatacat

SEQ ID NO: 114129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcagtacaccatacatgtat

SEQ ID NO: 114130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcagtcatccctctctttca

SEQ ID NO: 114131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagtcatccctctctttcaa

SEQ ID NO: 114132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtcatccctctctttcaag

SEQ ID NO: 114133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctttcaagagaggatttgt

SEQ ID NO: 114134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttcaagagaggatttgtct

SEQ ID NO: 114135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaagagaggatttgtctgg

SEQ ID NO: 114136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caagagaggatttgtctggg

SEQ ID NO: 114137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagagaggatttgtctggga

SEQ ID NO: 114138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtctgggaaacagacctgta

SEQ ID NO: 114139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctgggaaacagacctgtat

SEQ ID NO: 114140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaaacagacctgtataaag

SEQ ID NO: 114141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tataaagacagatgcaaacc

SEQ ID NO: 114142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gccaacaccaacctggcctt

SEQ ID NO: 114143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcctttcttccataaatatt

SEQ ID NO: 114144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttccataaatattaatag

SEQ ID NO: 114145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttccataaatattaataga

SEQ ID NO: 114146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttccataaatattaatagat

SEQ ID NO: 114147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccataaatattaatagatta

SEQ ID NO: 114148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cataaatattaatagattat

SEQ ID NO: 114149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atagattatcaagaataaat

SEQ ID NO: 114150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaagaataaattggtaatg

SEQ ID NO: 114151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtaatgaagatctaccaaac

SEQ ID NO: 114152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccaaacataaaattgaaaga

SEQ ID NO: 114153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaagactaagatgaacagac

SEQ ID NO: 114154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agatgaacagaccaaacttt

SEQ ID NO: 114155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaactttagaaaaaaaaaa

SEQ ID NO: 114156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taactttagaaaaaaaaaag

SEQ ID NO: 114157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactttagaaaaaaaaaagc

SEQ ID NO: 114158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actttagaaaaaaaaaagca

SEQ ID NO: 114159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagaaaaaaaaaagcaaaca

SEQ ID NO: 114160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaaaaaaaaaagcaaacat

SEQ ID NO: 114161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaaaaaaaaagcaaacatt

SEQ ID NO: 114162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgggatattgagaagttaaa

SEQ ID NO: 114163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaagttaaagttagtattc

SEQ ID NO: 114164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagttagtattcctagagaa

SEQ ID NO: 114165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtattcctagagaaatttga

SEQ ID NO: 114166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctagagaaatttgaggagac

SEQ ID NO: 114167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gagaaatttgaggagacaga

SEQ ID NO: 114168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaggagacagagtatctttt

SEQ ID NO: 114169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggagacagagtatctttta

SEQ ID NO: 114170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttattaaaaaaaaaaaatag

SEQ ID NO: 114171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattaaaaaaaaaaaatagg

SEQ ID NO: 114172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaaaaaaaaaaaataggc

SEQ ID NO: 114173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaaaaaaaaaaataggct

SEQ ID NO: 114174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaaaaaaataggctacc

SEQ ID NO: 114175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccaaaaacaacaacatcaat

SEQ ID NO: 114176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgggtaaaggtcatgctttg

SEQ ID NO: 114177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtaaaggtcatgctttgtg

SEQ ID NO: 114178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtgaaacaaaaaatttcag

SEQ ID NO: 114179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgaaacaaaaaatttcagt

SEQ ID NO: 114180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaaacaaaaaatttcagta

SEQ ID NO: 114181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagtagaatgcttgctgaaa

SEQ ID NO: 114182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtagaatgcttgctgaaaa

SEQ ID NO: 114183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctgaaaaggagaagtcata

SEQ ID NO: 114184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgaaaaggagaagtcataa

SEQ ID NO: 114185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaaggagaagtcataattg

SEQ ID NO: 114186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagttaccttttactttacc

SEQ ID NO: 114187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccttttactttacccaaaag

SEQ ID NO: 114188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttactttacccaaaaggggc

SEQ ID NO: 114189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tactttacccaaaaggggca

SEQ ID NO: 114190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actttacccaaaaggggcac

SEQ ID NO: 114191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttacccaaaaggggcact

SEQ ID NO: 114192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacccaaaaggggcacttta

SEQ ID NO: 114193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acccaaaaggggcactttac

SEQ ID NO: 114194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccaaaaggggcactttacc

SEQ ID NO: 114195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taccagaatggggcaccagt

SEQ ID NO: 114196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
accagaatggggcaccagtg

SEQ ID NO: 114197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccagaatggggcaccagtga

SEQ ID NO: 114198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaggtgctagaaacgttct

SEQ ID NO: 114199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggtgctagaaacgttctat

SEQ ID NO: 114200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaacgttctataccttgat

SEQ ID NO: 114201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tataccttgatctatgtgat

SEQ ID NO: 114202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taccttgatctatgtgatgg

SEQ ID NO: 114203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatctatgtgatggttacat

SEQ ID NO: 114204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atctatgtgatggttacatg

SEQ ID NO: 114205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtgatggttacatgggaaa

SEQ ID NO: 114206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catgggaaaatatgtatatg

SEQ ID NO: 114207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatatcttagatttttctat

SEQ ID NO: 114208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatcttagatttttctatat

SEQ ID NO: 114209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agatttttctatatatttta

SEQ ID NO: 114210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatttttctatatattttag

SEQ ID NO: 114211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctatatattttaggagaa

SEQ ID NO: 114212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctatatattttaggagaat

SEQ ID NO: 114213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatatattttaggagaatt

SEQ ID NO: 114214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatatattttaggagaattt

SEQ ID NO: 114215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatattttaggagaatttta

SEQ ID NO: 114216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taggagaattttaaaaatta

SEQ ID NO: 114217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggagaattttaaaaattaa

SEQ ID NO: 114218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggagaattttaaaaattaaa

SEQ ID NO: 114219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaattaaaaaagtacaa

SEQ ID NO: 114220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaattaaaaaagtacaaa

SEQ ID NO: 114221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaattaaaaaagtacaaaa

SEQ ID NO: 114222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaagtacaaaataaaact

SEQ ID NO: 114223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaagatacagaataatcca

SEQ ID NO: 114224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaagatacagaataatccat

SEQ ID NO: 114225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttcgacattagtctcaagag

SEQ ID NO: 114226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gacattagtctcaagagagc

SEQ ID NO: 114227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtctcaagagagcagcaaat

SEQ ID NO: 114228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagagagcagcaaatagtag

SEQ ID NO: 114229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accaagagtcatcaagctaa

SEQ ID NO: 114230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaagtacaaaagaagatcaa

SEQ ID NO: 114231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaagttccattcttgtgaa

SEQ ID NO: 114232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagttccattcttgtgaaa

SEQ ID NO: 114233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattcttgtgaaagtttaga

SEQ ID NO: 114234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgtgaaagtttagagcatt

SEQ ID NO: 114235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgaaagtttagagcattaa

SEQ ID NO: 114236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaaagtttagagcattaac

SEQ ID NO: 114237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agagcattaacaatagaaac

SEQ ID NO: 114238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagcattaacaatagaaaca

SEQ ID NO: 114239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaatagaaacaagatttta

SEQ ID NO: 114240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tataatcttccaaaaataag

SEQ ID NO: 114241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataatcttccaaaaataaga

SEQ ID NO: 114242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatcttccaaaaataagat

SEQ ID NO: 114243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaaaaataagataactaac

SEQ ID NO: 114244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaaaataagataactaact

SEQ ID NO: 114245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actaaaaagaatgaaaatta

SEQ ID NO: 114246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaagaatgaaaattagatt

SEQ ID NO: 114247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gattgccattaaaatttcct

SEQ ID NO: 114248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccattaaaatttccttagcc

SEQ ID NO: 114249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatttccttagccataatt

SEQ ID NO: 114250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttagccataattgacact

SEQ ID NO: 114251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttagccataattgacacta

SEQ ID NO: 114252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agccataattgacactagaa

SEQ ID NO: 114253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccataattgacactagaac

SEQ ID NO: 114254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acactagaacacaatcaatg

SEQ ID NO: 114255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaacacaatcaatgctttca

SEQ ID NO: 114256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcagtgtgatgagagaaaat

SEQ ID NO: 114257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagtgtgatgagagaaaata

SEQ ID NO: 114258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtgtgatgagagaaaatat

SEQ ID NO: 114259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaatcaaattctattatca

SEQ ID NO: 114260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaatcaaattctattatcag

SEQ ID NO: 114261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatcaaattctattatcaga

SEQ ID NO: 114262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattatcagacaacctatta

SEQ ID NO: 114263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttatcagacaacctattatc

SEQ ID NO: 114264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcagacaacctattatcaag

SEQ ID NO: 114265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttatcaagtgtgatggcaaa

SEQ ID NO: 114266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaagtgtgatggcaaacaa

SEQ ID NO: 114267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaggtataagaaaattcaa

SEQ ID NO: 114268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taggtataagaaaattcaaa

SEQ ID NO: 114269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtataagaaaattcaaaat

SEQ ID NO: 114270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaatttaactcctttttat

SEQ ID NO: 114271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactcctttttatctttttt

SEQ ID NO: 114272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actcctttttatcttttttt

SEQ ID NO: 114273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctttttatctttttttttta

SEQ ID NO: 114274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttatcttttttttttaagt

SEQ ID NO: 114275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatcttttttttttaagtt

SEQ ID NO: 114276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcttttttttttaagtta

SEQ ID NO: 114277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttttttttttaagttac

SEQ ID NO: 114278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttttttttttaagttact

SEQ ID NO: 114279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttttttaagttactttgg

SEQ ID NO: 114280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttaagttactttgga

SEQ ID NO: 114281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttaagttactttggat

SEQ ID NO: 114282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttaagttactttggatt

SEQ ID NO: 114283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaagttactttggatta

SEQ ID NO: 114284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaagttactttggattaa

SEQ ID NO: 114285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaagttactttggattaag

SEQ ID NO: 114286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagttactttggattaagg

SEQ ID NO: 114287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagttactttggattaaggt

SEQ ID NO: 114288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agttactttggattaaggta

SEQ ID NO: 114289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttggattaaggtagagca

SEQ ID NO: 114290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggattaaggtagagcaaaa

SEQ ID NO: 114291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggattaaggtagagcaaaaa

SEQ ID NO: 114292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gattaaggtagagcaaaaaa

SEQ ID NO: 114293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggtagagcaaaaaaaaaaa

SEQ ID NO: 114294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaaaacacatagaatacaa

SEQ ID NO: 114295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaaacacatagaatacaag

SEQ ID NO: 114296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaacacatagaatacaagat

SEQ ID NO: 114297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacaaatagtgtgaataaaa

SEQ ID NO: 114298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaaatagtgtgaataaaag

SEQ ID NO: 114299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttctttagaacgtgtaaa

SEQ ID NO: 114300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttctttagaacgtgtaaat

SEQ ID NO: 114301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttagaacgtgtaaatagc

SEQ ID NO: 114302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttagaacgtgtaaatagcc

SEQ ID NO: 114303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagaacgtgtaaatagccat

SEQ ID NO: 114304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaacgtgtaaatagccata

SEQ ID NO: 114305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaacgtgtaaatagccatat

SEQ ID NO: 114306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tccaaataggaatcaattca

SEQ ID NO: 114307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaatgaggcatgaacttga

SEQ ID NO: 114308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaacaactggtagaattgaa

SEQ ID NO: 114309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacaactggtagaattgaag

SEQ ID NO: 114310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtagaattgaagcagagagg

SEQ ID NO: 114311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagcagagaggatccacttg

SEQ ID NO: 114312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagtttgatgtgttcttcaa

SEQ ID NO: 114313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtttgatgtgttcttcaag

SEQ ID NO: 114314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatgtgttcttcaagtagca

SEQ ID NO: 114315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgtgttcttcaagtagcag

SEQ ID NO: 114316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcaagtagcagagtttgaa

SEQ ID NO: 114317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caagtagcagagtttgaatg

SEQ ID NO: 114318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagtagcagagtttgaatga

SEQ ID NO: 114319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaatgagaggtttaaattcc

SEQ ID NO: 114320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatgagaggtttaaattcct

SEQ ID NO: 114321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattcctcctctagatcaa

SEQ ID NO: 114322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattcctcctctagatcaaa

SEQ ID NO: 114323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcctctagatcaaaccatg

SEQ ID NO: 114324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctctagatcaaaccatgtta

SEQ ID NO: 114325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagatcaaaccatgttactt

SEQ ID NO: 114326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatcaaaccatgttacttgt

SEQ ID NO: 114327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttgttttaaaatgaaaaat

SEQ ID NO: 114328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttttaaaatgaaaaataca

SEQ ID NO: 114329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttaaaatgaaaaatacat

SEQ ID NO: 114330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaatgaaaaatacataca

SEQ ID NO: 114331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatgaaaaatacatacat

SEQ ID NO: 114332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgaaaaatacatacata

SEQ ID NO: 114333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatattgttaaattgtatc

SEQ ID NO: 114334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaaattgtatcagttaatc

SEQ ID NO: 114335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattgtatcagttaatcatc

SEQ ID NO: 114336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatcagttaatcatctcaca

SEQ ID NO: 114337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcatctcacaaatgtgcca

SEQ ID NO: 114338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acaaatgtgccaattaccaa

SEQ ID NO: 114339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccaaagcatatataaaatgt

SEQ ID NO: 114340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagaactttatttacacaaa

SEQ ID NO: 114341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatttacacaaagacaagat

SEQ ID NO: 114342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttacacaaagacaagata

SEQ ID NO: 114343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttacacaaagacaagatat

SEQ ID NO: 114344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acacaaagacaagatataca

SEQ ID NO: 114345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacaaagacaagatatacac

SEQ ID NO: 114346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatattatcagtgtaaaagt

SEQ ID NO: 114347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcagtgtaaaagtaatggaa

SEQ ID NO: 114348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acaaaaattgagaggtagag

SEQ ID NO: 114349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaaaattgagaggtagagg

SEQ ID NO: 114350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaggtagagggggattagt

SEQ ID NO: 114351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtggtgagggaaaagttgga

SEQ ID NO: 114352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagagctgaccccttatctt

SEQ ID NO: 114353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
accccttatcttacattgaa

SEQ ID NO: 114354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atcttacattgaaggcagtt

SEQ ID NO: 114355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttacattgaaggcagtta

SEQ ID NO: 114356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acattgaaggcagttagtgc

SEQ ID NO: 114357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cattgaaggcagttagtgca

SEQ ID NO: 114358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaggcagttagtgcatcctg

SEQ ID NO: 114359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgcatcctggctaaagttt

SEQ ID NO: 114360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctaaagtttaagtaacaag

SEQ ID NO: 114361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtttaagtaacaagaaat

SEQ ID NO: 114362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagtaacaagaaatagaggt

SEQ ID NO: 114363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtaacaagaaatagaggtt

SEQ ID NO: 114364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggtatattccatttaaagg

SEQ ID NO: 114365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catttaaaggtataaatcca

SEQ ID NO: 114366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaggtataaatccaaccca

SEQ ID NO: 114367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaggtataaatccaacccat

SEQ ID NO: 114368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttagaaatgaaaacataac

SEQ ID NO: 114369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaaatgaaaacataactgc

SEQ ID NO: 114370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaatgaaaacataactgct

SEQ ID NO: 114371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttggaatttgagaatgggg

SEQ ID NO: 114372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaatttgagaatggggcag

SEQ ID NO: 114373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaatttgagaatggggcaga

SEQ ID NO: 114374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagaatggggcagaaagaga

SEQ ID NO: 114375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaatggggcagaaagagaa

SEQ ID NO: 114376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acataaataaaataaattcc

SEQ ID NO: 114377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cataaataaaataaattcct

SEQ ID NO: 114378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcattttcaaattagaaag

SEQ ID NO: 114379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attttcaaattagaaagtta

SEQ ID NO: 114380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaattagaaagttagaaa

SEQ ID NO: 114381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaattagaaagttagaaaa

SEQ ID NO: 114382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaattagaaagttagaaaac

SEQ ID NO: 114383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaagttagaaaacattaca

SEQ ID NO: 114384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaaacattacataagttga

SEQ ID NO: 114385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cataagttgatgaaataaaa

SEQ ID NO: 114386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgaaataaaaatgagacat

SEQ ID NO: 114387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttagagataaaaaggaaaa

SEQ ID NO: 114388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agagataaaaaggaaaatat

SEQ ID NO: 114389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagataaaaaggaaaatatc

SEQ ID NO: 114390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttttaaaaaagcgggaag

SEQ ID NO: 114391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttaaaaaagcgggaagt

SEQ ID NO: 114392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaaaaaagcgggaagtg

SEQ ID NO: 114393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaaaaagcgggaagtga

SEQ ID NO: 114394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaaaagcgggaagtgat

SEQ ID NO: 114395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaaagcgggaagtgatt

SEQ ID NO: 114396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaagcgggaagtgatta

SEQ ID NO: 114397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaagcgggaagtgattat

SEQ ID NO: 114398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttccctagataatggcttta

SEQ ID NO: 114399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctagataatggctttaaag

SEQ ID NO: 114400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gataatggctttaaagggat

SEQ ID NO: 114401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaagggataaagcaaaaat

SEQ ID NO: 114402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagggataaagcaaaaatt

SEQ ID NO: 114403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagggataaagcaaaaattg

SEQ ID NO: 114404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgaattagttaccatgtg

SEQ ID NO: 114405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaattagttaccatgtgcat

SEQ ID NO: 114406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattagttaccatgtgcatt

SEQ ID NO: 114407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttaccatgtgcatttgtta

SEQ ID NO: 114408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccatgtgcatttgttaattt

SEQ ID NO: 114409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttaattttataatagttat

SEQ ID NO: 114410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaattttataatagttatt

SEQ ID NO: 114411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttataatagttattatt

SEQ ID NO: 114412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tataatagttattattatga

SEQ ID NO: 114413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataatagttattattatgat

SEQ ID NO: 114414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatagttattattatgatt

SEQ ID NO: 114415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattatgattaaaaagctg

SEQ ID NO: 114416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatgattaaaaagctgtaa

SEQ ID NO: 114417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgattaaaaagctgtaaaat

SEQ ID NO: 114418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaagctgtaaaataaaaga

SEQ ID NO: 114419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaaataaaagaagatatta

SEQ ID NO: 114420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacctctctcttgagccaaa

SEQ ID NO: 114421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctcttgagccaaagaaacc

SEQ ID NO: 114422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcttgagccaaagaaaccaa

SEQ ID NO: 114423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgagccaaagaaaccaaca

SEQ ID NO: 114424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagccaaagaaaccaacaaa

SEQ ID NO: 114425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agccaaagaaaccaacaaac

SEQ ID NO: 114426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttaagtagaaactgttctg

SEQ ID NO: 114427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagtagaaactgttctgtta

SEQ ID NO: 114428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtagaaactgttctgttac

SEQ ID NO: 114429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttctgttaccttcactgggc

SEQ ID NO: 114430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttaccttcactgggcttg

SEQ ID NO: 114431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttaccttcactgggcttgaa

SEQ ID NO: 114432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccttcactgggcttgaaaaa

SEQ ID NO: 114433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cactgggcttgaaaaatatg

SEQ ID NO: 114434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actgggcttgaaaaatatgg

SEQ ID NO: 114435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcttgaaaaatatggactg

SEQ ID NO: 114436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaaaatatggactgactct

SEQ ID NO: 114437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaatatggactgactcta

SEQ ID NO: 114438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actctacacctttcaaacac

SEQ ID NO: 114439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tacacctttcaaacaccata

SEQ ID NO: 114440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacctttcaaacaccatata

SEQ ID NO: 114441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaaacaccatatatttaga

SEQ ID NO: 114442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaacaccatatatttagat

SEQ ID NO: 114443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaacaccatatatttagata

SEQ ID NO: 114444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agatacattattttgatctc

SEQ ID NO: 114445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatacattattttgatctct

SEQ ID NO: 114446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttgatctctttcaggtaa

SEQ ID NO: 114447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgatctctttcaggtaaatt

SEQ ID NO: 114448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatctctttcaggtaaattg

SEQ ID NO: 114449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atctctttcaggtaaattgg

SEQ ID NO: 114450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttcaggtaaattggagaca

SEQ ID NO: 114451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaggtaaattggagacaat

SEQ ID NO: 114452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caggtaaattggagacaatt

SEQ ID NO: 114453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggtaaattggagacaattt

SEQ ID NO: 114454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagacaatttgcaattcatt

SEQ ID NO: 114455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaattcatttttattaata

SEQ ID NO: 114456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caattcatttttattaatat

SEQ ID NO: 114457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttttattaatatttcttc

SEQ ID NO: 114458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattaatatttcttcttca

SEQ ID NO: 114459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattaatatttcttcttcaa

SEQ ID NO: 114460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaatatttcttcttcaag

SEQ ID NO: 114461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaatatttcttcttcaagg

SEQ ID NO: 114462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatttcttcttcaagggac

SEQ ID NO: 114463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcttcaagggaccatctg

SEQ ID NO: 114464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcttcaagggaccatctga

SEQ ID NO: 114465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttcaagggaccatctgaca

SEQ ID NO: 114466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcaagggaccatctgacac

SEQ ID NO: 114467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caagggaccatctgacacac

SEQ ID NO: 114468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagggaccatctgacacact

SEQ ID NO: 114469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acacactgcaaacactcaaa

SEQ ID NO: 114470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caaacactcaaagttacagt

SEQ ID NO: 114471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaagttacagtaaagattgt

SEQ ID NO: 114472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagtaaagattgtgtcttct

SEQ ID NO: 114473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtcttctactttctctgct

SEQ ID NO: 114474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctactttctctgcttagatg

SEQ ID NO: 114475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tactttctctgcttagatga

SEQ ID NO: 114476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctttctctgcttagatgaat

SEQ ID NO: 114477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctctgcttagatgaatact

SEQ ID NO: 114478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctgcttagatgaatactg

SEQ ID NO: 114479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgcttagatgaatactga

SEQ ID NO: 114480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcttagatgaatactgaac

SEQ ID NO: 114481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttagatgaatactgaacac

SEQ ID NO: 114482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agatgaatactgaacacttc

SEQ ID NO: 114483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatgaatactgaacacttca

SEQ ID NO: 114484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacacttcattgggtgctac

SEQ ID NO: 114485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattgggtgctaccaatggc

SEQ ID NO: 114486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attgggtgctaccaatggct

SEQ ID NO: 114487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggtgctaccaatggctggct

SEQ ID NO: 114488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccaatggctggcttgctgaa

SEQ ID NO: 114489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcttgctgaatgcatggttt

SEQ ID NO: 114490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctgaatgcatggttttcaa

SEQ ID NO: 114491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgaatgcatggttttcaac

SEQ ID NO: 114492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatgcatggttttcaacaat

SEQ ID NO: 114493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaacaatatcaatcttcct

SEQ ID NO: 114494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caacaatatcaatcttccta

SEQ ID NO: 114495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacaatatcaatcttcctat

SEQ ID NO: 114496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctattatctgacaccaatt

SEQ ID NO: 114497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctattatctgacaccaattc

SEQ ID NO: 114498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttatctgacaccaattcttc

SEQ ID NO: 114499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgacaccaattcttccat

SEQ ID NO: 114500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acaccaattcttccatagtg

SEQ ID NO: 114501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttccatagtgagctttgaga

SEQ ID NO: 114502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccatagtgagctttgagatg

SEQ ID NO: 114503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catagtgagctttgagatgt

SEQ ID NO: 114504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgagatgtgggcattacatg

SEQ ID NO: 114505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagatgtgggcattacatga

SEQ ID NO: 114506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agatgtgggcattacatgat

SEQ ID NO: 114507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catgatacttaataccaata

SEQ ID NO: 114508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aataccaataacccacaaca

SEQ ID NO: 114509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataccaataacccacaacac

SEQ ID NO: 114510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgttttattatctgctgtt

SEQ ID NO: 114511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattatctgctgttttccaa

SEQ ID NO: 114512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attatctgctgttttccaaa

SEQ ID NO: 114513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatctgctgttttccaaaa

SEQ ID NO: 114514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgctgttttccaaaatac

SEQ ID NO: 114515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctgttttccaaaatactact

SEQ ID NO: 114516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttccaaaatactactgtt

SEQ ID NO: 114517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccaaaatactactgtttta

SEQ ID NO: 114518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaaaatactactgttttaa

SEQ ID NO: 114519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaaatactactgttttaaa

SEQ ID NO: 114520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgttttaaaatccctttca

SEQ ID NO: 114521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttaaaatccctttcactt

SEQ ID NO: 114522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaatccctttcacttatg

SEQ ID NO: 114523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatccctttcacttatgt

SEQ ID NO: 114524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatccctttcacttatgtt

SEQ ID NO: 114525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcacttatgttaggtaatgt

SEQ ID NO: 114526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacttatgttaggtaatgtt

SEQ ID NO: 114527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acttatgttaggtaatgtta

SEQ ID NO: 114528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgttaggtaatgttaaaaa

SEQ ID NO: 114529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgttaggtaatgttaaaaat

SEQ ID NO: 114530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtaatgttaaaaatgcagc

SEQ ID NO: 114531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatgcagctaagtatcat

SEQ ID NO: 114532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtatcatttgtctctatgg

SEQ ID NO: 114533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtctctatggttgtcaagag

SEQ ID NO: 114534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctctatggttgtcaagagt

SEQ ID NO: 114535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatggttgtcaagagtgtat

SEQ ID NO: 114536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggttgtcaagagtgtatat

SEQ ID NO: 114537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaagagtgtatatatcaga

SEQ ID NO: 114538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cactgtggctattgaccagg

SEQ ID NO: 114539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggctattgaccagggtata

SEQ ID NO: 114540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgaccagggtatacaaaaa

SEQ ID NO: 114541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
accagggtatacaaaaaaat

SEQ ID NO: 114542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtaacctaaaaaaatacag

SEQ ID NO: 114543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaaaatacagatgccaggg

SEQ ID NO: 114544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atctaagtaatgctgaaata

SEQ ID NO: 114545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctaagtaatgctgaaataa

SEQ ID NO: 114546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtaatgctgaaataaaagt

SEQ ID NO: 114547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaataaaagttttagggaag

SEQ ID NO: 114548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagggaagagcataagcatg

SEQ ID NO: 114549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agggaagagcataagcatgt

SEQ ID NO: 114550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gggaagagcataagcatgtc

SEQ ID NO: 114551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttttaaaaagcataaaata

SEQ ID NO: 114552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaaaagcataaaatacta

SEQ ID NO: 114553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaagcataaaatactaa

SEQ ID NO: 114554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaagcataaaatactaac

SEQ ID NO: 114555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaagcataaaatactaacg

SEQ ID NO: 114556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acgtgaaccctccatttgat

SEQ ID NO: 114557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catttgattttgttaaatca

SEQ ID NO: 114558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gattttgttaaatcaaaaat

SEQ ID NO: 114559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attttgttaaatcaaaaata

SEQ ID NO: 114560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttaaatcaaaaatatcag

SEQ ID NO: 114561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttaaatcaaaaatatcaga

SEQ ID NO: 114562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaaatcaaaaatatcagat

SEQ ID NO: 114563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatcaaaaatatcagatgag

SEQ ID NO: 114564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattattcaaaaggagagaa

SEQ ID NO: 114565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attattcaaaaggagagaaa

SEQ ID NO: 114566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattcaaaaggagagaaaa

SEQ ID NO: 114567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcaaaaggagagaaaaaat

SEQ ID NO: 114568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaggagagaaaaaattca

SEQ ID NO: 114569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aattcaaaaagtagaaaagt

SEQ ID NO: 114570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaagtagaaaagtttttg

SEQ ID NO: 114571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttggattttgtttggtttga

SEQ ID NO: 114572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggattttgtttggtttgaa

SEQ ID NO: 114573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggattttgtttggtttgaag

SEQ ID NO: 114574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gattttgtttggtttgaaga

SEQ ID NO: 114575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtttggtttgaagacaatg

SEQ ID NO: 114576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttggtttgaagacaatga

SEQ ID NO: 114577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttggtttgaagacaatgaa

SEQ ID NO: 114578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtttgaagacaatgaatgt

SEQ ID NO: 114579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtttgaagacaatgaatgta

SEQ ID NO: 114580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaagacaatgaatgtaaaat

SEQ ID NO: 114581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagacaatgaatgtaaaata

SEQ ID NO: 114582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaagttaactattttaaaa

SEQ ID NO: 114583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagttaactattttaaaat

SEQ ID NO: 114584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagttaactattttaaaatt

SEQ ID NO: 114585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actattttaaaattggaaag

SEQ ID NO: 114586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttaaaattggaaaggata

SEQ ID NO: 114587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaattggaaaggataaac

SEQ ID NO: 114588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaattggaaaggataaaca

SEQ ID NO: 114589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattggaaaggataaacat

SEQ ID NO: 114590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaaggataaacataaattc

SEQ ID NO: 114591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattcaatagaccaggcaca

SEQ ID NO: 114592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatagaccaggcacagtggc

SEQ ID NO: 114593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gtgcctgtaattccaacatt

SEQ ID NO: 114594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taattccaacattttcggag

SEQ ID NO: 114595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caacattttcggaggccaag

SEQ ID NO: 114596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcggaggccaaggcgggtga

SEQ ID NO: 114597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cggaggccaaggcgggtgaa

SEQ ID NO: 114598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ggaggccaaggcgggtgaat

SEQ ID NO: 114599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagggcaggagttcaagaac

SEQ ID NO: 114600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agggcaggagttcaagaaca

SEQ ID NO: 114601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagaacagcatgggcaacac

SEQ ID NO: 114602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctctaggaaaagtacaaaa

SEQ ID NO: 114603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taggaaaagtacaaaaatta

SEQ ID NO: 114604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggaaaagtacaaaaattagc

SEQ ID NO: 114605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccaggcatggagctgtgca

SEQ ID NO: 114606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgcacctgtagtctcagctg

SEQ ID NO: 114607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagtctcagctgcttgagag

SEQ ID NO: 114608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agctgcttgagagtagctaa

SEQ ID NO: 114609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttgagagtagctaaggtgg

SEQ ID NO: 114610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagagtagctaaggtgggag

SEQ ID NO: 114611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agagtagctaaggtgggagg

SEQ ID NO: 114612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aggtgggaggatcacctgag

SEQ ID NO: 114613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agcctggggaggttgagtct

SEQ ID NO: 114614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gggaggttgagtctgcagtg

SEQ ID NO: 114615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtctgcagtgagccatgat

SEQ ID NO: 114616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagtgagccatgatcacacc

SEQ ID NO: 114617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cggtccagcttggatgacag

SEQ ID NO: 114618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggatgacagacagagaccct

SEQ ID NO: 114619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gatgacagacagagaccctg

SEQ ID NO: 114620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctcaaaaaaaaaaaaaaaa

SEQ ID NO: 114621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaaaaaaaaaaaaaatcta

SEQ ID NO: 114622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaattcaatagaaacaaca

SEQ ID NO: 114623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatagaaacaacacatattt

SEQ ID NO: 114624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaactccgagtctctatta

SEQ ID NO: 114625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaactccgagtctctattat

SEQ ID NO: 114626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aactccgagtctctattatg

SEQ ID NO: 114627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cgagtctctattatgttcaa

SEQ ID NO: 114628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tattatgttcaattaaagaa

SEQ ID NO: 114629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttatgttcaattaaagaaag

SEQ ID NO: 114630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgttcaattaaagaaagaag

SEQ ID NO: 114631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aattaaagaaagaagagttg

SEQ ID NO: 114632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagaaagaagagttggaatg

SEQ ID NO: 114633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaatgaggggaaaaactgaa

SEQ ID NO: 114634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatgaaaaaaatggaagttg

SEQ ID NO: 114635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaggagagaaggaagatgat

SEQ ID NO: 114636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcaatgttttaatatttac

SEQ ID NO: 114637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaatgttttaatatttact

SEQ ID NO: 114638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatgttttaatatttactt

SEQ ID NO: 114639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgttttaatatttacttt

SEQ ID NO: 114640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatatttactttttaattc

SEQ ID NO: 114641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatatttactttttaattct

SEQ ID NO: 114642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatttactttttaattctc

SEQ ID NO: 114643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actttttaattctcaacatt

SEQ ID NO: 114644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttttaattctcaacattt

SEQ ID NO: 114645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttaattctcaacattttaa

SEQ ID NO: 114646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaattctcaacattttaag

SEQ ID NO: 114647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattctcaacattttaagc

SEQ ID NO: 114648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattctcaacattttaagca

SEQ ID NO: 114649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attctcaacattttaagcat

SEQ ID NO: 114650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaacattttaagcatcatt

SEQ ID NO: 114651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aacattttaagcatcattca

SEQ ID NO: 114652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagcatcattcatgtcact

SEQ ID NO: 114653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagcatcattcatgtcactt

SEQ ID NO: 114654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcatcattcatgtcactta

SEQ ID NO: 114655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtcacttatatcacttca

SEQ ID NO: 114656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atatcacttcattccaatta

SEQ ID NO: 114657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatcacttcattccaattat

SEQ ID NO: 114658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattccaattatagcctggc

SEQ ID NO: 114659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attccaattatagcctggca

SEQ ID NO: 114660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caattatagcctggcaaaat

SEQ ID NO: 114661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagcctggcaaaatcttttt

SEQ ID NO: 114662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcaaaatctttttttttttt

SEQ ID NO: 114663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttttttttttttttggt

SEQ ID NO: 114664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttttttttttggta

SEQ ID NO: 114665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttggtaa

SEQ ID NO: 114666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttttttttggtaac

SEQ ID NO: 114667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttggtaact

SEQ ID NO: 114668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttttttggtaactc

SEQ ID NO: 114669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttggtaactct

SEQ ID NO: 114670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttttggtaactctt

SEQ ID NO: 114671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttggtaactctta

SEQ ID NO: 114672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttggtaactcttat

SEQ ID NO: 114673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttggtaactcttatt

SEQ ID NO: 114674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttggtaactcttattc

SEQ ID NO: 114675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttggtaactcttattct

SEQ ID NO: 114676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttggtaactcttattctc

SEQ ID NO: 114677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttggtaactcttattctct

SEQ ID NO: 114678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttggtaactcttattctctc

SEQ ID NO: 114679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggtaactcttattctctcc

SEQ ID NO: 114680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtaactcttattctctcca

SEQ ID NO: 114681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtaactcttattctctccaa

SEQ ID NO: 114682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttattctctccaagttcttt

SEQ ID NO: 114683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attctctccaagttcttttg

SEQ ID NO: 114684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctctccaagttcttttga

SEQ ID NO: 114685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctccaagttcttttgaggc

SEQ ID NO: 114686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tccaagttcttttgaggcat

SEQ ID NO: 114687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caagttcttttgaggcatgc

SEQ ID NO: 114688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttgaggcatgcagtgctc

SEQ ID NO: 114689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgaggcatgcagtgctcct

SEQ ID NO: 114690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaggcatgcagtgctcctc

SEQ ID NO: 114691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaggcatgcagtgctcctcc

SEQ ID NO: 114692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggcatgcagtgctcctcct

SEQ ID NO: 114693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcctcagagttttgctcat

SEQ ID NO: 114694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcagagttttgctcatact

SEQ ID NO: 114695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agagttttgctcatactcac

SEQ ID NO: 114696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctcatactcactcatccc

SEQ ID NO: 114697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctcatactcactcatccct

SEQ ID NO: 114698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcatactcactcatccctc

SEQ ID NO: 114699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atactcactcatccctcatc

SEQ ID NO: 114700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actcatccctcatcctccaa

SEQ ID NO: 114701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atccctcatcctccaaacct

SEQ ID NO: 114702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atcctccaaacctgtcagct

SEQ ID NO: 114703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caaacctgtcagctctaaag

SEQ ID NO: 114704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcagctctaaagcatcctca

SEQ ID NO: 114705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taaagcatcctcagtcaatc

SEQ ID NO: 114706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagcatcctcagtcaatctg

SEQ ID NO: 114707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agtcaatctgttgtcaagca

SEQ ID NO: 114708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgtcaagcaataagcaaga

SEQ ID NO: 114709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaagcaataagcaagaaga

SEQ ID NO: 114710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgatgctgtaaaataatca

SEQ ID NO: 114711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatgctgtaaaataatcaag

SEQ ID NO: 114712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgctgtaaaataatcaaga

SEQ ID NO: 114713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaaataatcaagagttaca

SEQ ID NO: 114714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cattaggtctttcctagcat

SEQ ID NO: 114715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtctttcctagcatttatt

SEQ ID NO: 114716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcctagcatttattttaaaa

SEQ ID NO: 114717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctagcatttattttaaaac

SEQ ID NO: 114718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctagcatttattttaaaacg

SEQ ID NO: 114719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcatttattttaaaacgctg

SEQ ID NO: 114720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttaaaacgctgatcttc

SEQ ID NO: 114721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaaaacgctgatcttcc

SEQ ID NO: 114722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaacgctgatcttccaac

SEQ ID NO: 114723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaacgctgatcttccaact

SEQ ID NO: 114724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaacgctgatcttccaactt

SEQ ID NO: 114725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atcttccaactttcaggaat

SEQ ID NO: 114726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaactttcaggaatgtgta

SEQ ID NO: 114727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caactttcaggaatgtgtaa

SEQ ID NO: 114728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaggaatgtgtaacaacat

SEQ ID NO: 114729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caggaatgtgtaacaacatt

SEQ ID NO: 114730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggaatgtgtaacaacattc

SEQ ID NO: 114731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaagaaaggacaaagata

SEQ ID NO: 114732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaagaaatagatttatttta

SEQ ID NO: 114733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttatcagcctaataact

SEQ ID NO: 114734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttatcagcctaataacta

SEQ ID NO: 114735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcagcctaataactaaaa

SEQ ID NO: 114736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcagcctaataactaaaaa

SEQ ID NO: 114737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcagcctaataactaaaaat

SEQ ID NO: 114738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ataactaaaaatttgtatta

SEQ ID NO: 114739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaatttgtattactttatg

SEQ ID NO: 114740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtattactttatgaaacact

SEQ ID NO: 114741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattactttatgaaacacta

SEQ ID NO: 114742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttatgaaacactacttag

SEQ ID NO: 114743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatgaaacactacttagaaa

SEQ ID NO: 114744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgaaacactacttagaaaa

SEQ ID NO: 114745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgaaacactacttagaaaac

SEQ ID NO: 114746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttagaaaacacttttttaa

SEQ ID NO: 114747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaaaacacttttttaaaaa

SEQ ID NO: 114748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaaacacttttttaaaaaa

SEQ ID NO: 114749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttaaaaaaaatttcattt

SEQ ID NO: 114750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaaaaaaatttcatttt

SEQ ID NO: 114751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaaaaaatttcatttta

SEQ ID NO: 114752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaaaaatttcattttat

SEQ ID NO: 114753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaaaatttcattttatt

SEQ ID NO: 114754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaaatttcattttattt

SEQ ID NO: 114755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattttatttgagtttctat

SEQ ID NO: 114756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attttatttgagtttctata

SEQ ID NO: 114757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttgagtttctatagttt

SEQ ID NO: 114758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttgagtttctatagtttc

SEQ ID NO: 114759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgagtttctatagtttct

SEQ ID NO: 114760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagtttctatagtttcttct

SEQ ID NO: 114761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtttctatagtttcttctt

SEQ ID NO: 114762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatagtttcttcttaattt

SEQ ID NO: 114763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatagtttcttcttaatttg

SEQ ID NO: 114764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagtttcttcttaatttgga

SEQ ID NO: 114765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcttaatttggagctttt

SEQ ID NO: 114766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcttaatttggagcttttg

SEQ ID NO: 114767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttaatttggagcttttgta

SEQ ID NO: 114768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaatttggagcttttgtaa

SEQ ID NO: 114769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatttggagcttttgtaaaa

SEQ ID NO: 114770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttggagcttttgtaaaat

SEQ ID NO: 114771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggagcttttgtaaaatcttt

SEQ ID NO: 114772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagcttttgtaaaatcttta

SEQ ID NO: 114773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgtaaaatctttaatatac

SEQ ID NO: 114774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaaaatctttaatataca

SEQ ID NO: 114775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaaaatctttaatatacag

SEQ ID NO: 114776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaaatctttaatatacagc

SEQ ID NO: 114777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taatatacagctcgatttcc

SEQ ID NO: 114778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatatacagctcgatttcca

SEQ ID NO: 114779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatacagctcgatttccat

SEQ ID NO: 114780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gatttccatttgatccaatg

SEQ ID NO: 114781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccatttgatccaatgtaaaa

SEQ ID NO: 114782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catttgatccaatgtaaaat

SEQ ID NO: 114783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatccaatgtaaaatgaata

SEQ ID NO: 114784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atccaatgtaaaatgaataa

SEQ ID NO: 114785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagcaacagttacaatatat

SEQ ID NO: 114786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agcaacagttacaatatata

SEQ ID NO: 114787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caatatatatcatgaagtgt

SEQ ID NO: 114788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctattccatacagaacaatt

SEQ ID NO: 114789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattccatacagaacaattc

SEQ ID NO: 114790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttccatacagaacaattcac

SEQ ID NO: 114791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catacagaacaattcacact

SEQ ID NO: 114792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acactggtttcagtggctca

SEQ ID NO: 114793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtttcagtggctcacaggtc

SEQ ID NO: 114794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagtggctcacaggtcaata

SEQ ID NO: 114795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtggctcacaggtcaataa

SEQ ID NO: 114796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acaggtcaataatcatcttg

SEQ ID NO: 114797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcctttcccattacaattt

SEQ ID NO: 114798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcctttcccattacaatttg

SEQ ID NO: 114799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcccattacaatttgtgctc

SEQ ID NO: 114800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccattacaatttgtgctcc

SEQ ID NO: 114801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccattacaatttgtgctcca

SEQ ID NO: 114802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caatttgtgctccacatttt

SEQ ID NO: 114803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgctccacattttagagct

SEQ ID NO: 114804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgctccacattttagagctg

SEQ ID NO: 114805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cacattttagagctgttgac

SEQ ID NO: 114806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagagctgttgaccctgtgg

SEQ ID NO: 114807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agagctgttgaccctgtgga

SEQ ID NO: 114808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagctgttgaccctgtggag

SEQ ID NO: 114809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgaccctgtggagatgaca

SEQ ID NO: 114810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
accctgtggagatgacataa

SEQ ID NO: 114811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggagatgacataacctctc

SEQ ID NO: 114812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctgagcctaagattcctag

SEQ ID NO: 114813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgagcctaagattcctagtt

SEQ ID NO: 114814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agcctaagattcctagtttg

SEQ ID NO: 114815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agattcctagtttgaaaaat

SEQ ID NO: 114816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctagtttgaaaaattgagtt

SEQ ID NO: 114817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtttgaaaaattgagttaat

SEQ ID NO: 114818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaaattgagttaataatc

SEQ ID NO: 114819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaattgagttaataatca

SEQ ID NO: 114820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agttaataatcatgctccga

SEQ ID NO: 114821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataatcatgctccgaagagt

SEQ ID NO: 114822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cgaagagtggtttagattgt

SEQ ID NO: 114823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agattgtgatggttaactgt

SEQ ID NO: 114824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gattgtgatggttaactgta

SEQ ID NO: 114825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgatggttaactgtatataa

SEQ ID NO: 114826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actgtatataaagtgcttaa

SEQ ID NO: 114827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatataaagtgcttaacagg

SEQ ID NO: 114828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacaggaagagttttgcaca

SEQ ID NO: 114829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaggaagagttttgcacat

SEQ ID NO: 114830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcacataatgaacacgtat

SEQ ID NO: 114831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcacataatgaacacgtatt

SEQ ID NO: 114832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cacataatgaacacgtattc

SEQ ID NO: 114833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atggagctcataagattatt

SEQ ID NO: 114834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataagattattaacttgtct

SEQ ID NO: 114835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaacttgtctcatccttct

SEQ ID NO: 114836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acttgtctcatccttctatt

SEQ ID NO: 114837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtctcatccttctattttaa

SEQ ID NO: 114838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctcatccttctattttaat

SEQ ID NO: 114839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atccttctattttaattcct

SEQ ID NO: 114840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctattttaattccttgcttt

SEQ ID NO: 114841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattttaattccttgctttg

SEQ ID NO: 114842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttaattccttgctttgga

SEQ ID NO: 114843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattccttgctttggataa

SEQ ID NO: 114844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattccttgctttggataat

SEQ ID NO: 114845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attccttgctttggataatt

SEQ ID NO: 114846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttgctttggataattttat

SEQ ID NO: 114847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctttggataattttatcat

SEQ ID NO: 114848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttggataattttatcatg

SEQ ID NO: 114849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggataattttatcatgctt

SEQ ID NO: 114850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggataattttatcatgcttc

SEQ ID NO: 114851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gataattttatcatgcttcc

SEQ ID NO: 114852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcatgcttccataattaa

SEQ ID NO: 114853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcatgcttccataattaaa

SEQ ID NO: 114854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcatgcttccataattaaaa

SEQ ID NO: 114855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccataattaaaatatattaa

SEQ ID NO: 114856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cataattaaaatatattaat

SEQ ID NO: 114857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatatattaattatattaa

SEQ ID NO: 114858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attatattaaatgaggatat

SEQ ID NO: 114859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattaaatgaggatatttcc

SEQ ID NO: 114860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgaggatatttccattta

SEQ ID NO: 114861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccatttatgggaatgtattg

SEQ ID NO: 114862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catttatgggaatgtattgg

SEQ ID NO: 114863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgggaatgtattggccttt

SEQ ID NO: 114864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgggaatgtattggcctttt

SEQ ID NO: 114865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gccttttaaacatgaaacat

SEQ ID NO: 114866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaacatgaaacatttcat

SEQ ID NO: 114867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaacatgaaacatttcata

SEQ ID NO: 114868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaacatgaaacatttcatat

SEQ ID NO: 114869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacatgaaacatttcatatg

SEQ ID NO: 114870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catatgagcatgtaatatta

SEQ ID NO: 114871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatgagcatgtaatattaa

SEQ ID NO: 114872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacagagatttagtttagag

SEQ ID NO: 114873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtttagagtagtgagtcta

SEQ ID NO: 114874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtttagagtagtgagtctag

SEQ ID NO: 114875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agagtagtgagtctaggaca

SEQ ID NO: 114876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagtagtgagtctaggacaa

SEQ ID NO: 114877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggacaagttcaggagctaga

SEQ ID NO: 114878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggagctagaaagcctgggt

SEQ ID NO: 114879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaagcctgggttttgaata

SEQ ID NO: 114880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggttttgaatactggattca

SEQ ID NO: 114881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaatactggattcactact

SEQ ID NO: 114882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaatactggattcactactt

SEQ ID NO: 114883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatactggattcactactta

SEQ ID NO: 114884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gattcactacttactagcta

SEQ ID NO: 114885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actacttactagctaaatga

SEQ ID NO: 114886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttactagctaaatgatctt

SEQ ID NO: 114887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actagctaaatgatcttgga

SEQ ID NO: 114888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctagctaaatgatcttggac

SEQ ID NO: 114889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctaaatgatcttggacatc

SEQ ID NO: 114890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatgatcttggacatcccag

SEQ ID NO: 114891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggacatcccagttaagcaac

SEQ ID NO: 114892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gacatcccagttaagcaact

SEQ ID NO: 114893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcaacttttctgattctaa

SEQ ID NO: 114894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctgattctaaaaatgttg

SEQ ID NO: 114895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgattctaaaaatgttga

SEQ ID NO: 114896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgattctaaaaatgttgag

SEQ ID NO: 114897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgattctaaaaatgttgagg

SEQ ID NO: 114898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attctaaaaatgttgaggca

SEQ ID NO: 114899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaaaatgttgaggcattta

SEQ ID NO: 114900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaatgttgaggcatttagg

SEQ ID NO: 114901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggcatttaggacattattt

SEQ ID NO: 114902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggacattatttattttgta

SEQ ID NO: 114903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggacattatttattttgtaa

SEQ ID NO: 114904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttattttgtaaaatgtaat

SEQ ID NO: 114905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttgtaaaatgtaatttt

SEQ ID NO: 114906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttgtaaaatgtaatttta

SEQ ID NO: 114907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaaaatgtaattttaaac

SEQ ID NO: 114908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaaaatgtaattttaaaca

SEQ ID NO: 114909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaaatgtaattttaaacaa

SEQ ID NO: 114910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaacaatacaagagtatcc

SEQ ID NO: 114911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaacaatacaagagtatccc

SEQ ID NO: 114912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacaatacaagagtatccct

SEQ ID NO: 114913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaatgactgttgattgctca

SEQ ID NO: 114914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgattgctcaaaggattgg

SEQ ID NO: 114915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attgctcaaaggattgggtc

SEQ ID NO: 114916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcaaaggattgggtcactg

SEQ ID NO: 114917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaggattgggtcactgcag

SEQ ID NO: 114918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggtcactgcagaatttcctt

SEQ ID NO: 114919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagaatttcctttcttaaga

SEQ ID NO: 114920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctttcttaagaaaattccc

SEQ ID NO: 114921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttcttaagaaaattccca

SEQ ID NO: 114922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttaagaaaattcccatca

SEQ ID NO: 114923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttaagaaaattcccatcat

SEQ ID NO: 114924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaagaaaattcccatcatt

SEQ ID NO: 114925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagaaaattcccatcatttc

SEQ ID NO: 114926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaaaattcccatcatttca

SEQ ID NO: 114927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccatcatttcacctttgttg

SEQ ID NO: 114928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacctttgttgttttgaact

SEQ ID NO: 114929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acctttgttgttttgaactt

SEQ ID NO: 114930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgttgttttgaactttatat

SEQ ID NO: 114931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttgttttgaactttatatg

SEQ ID NO: 114932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgttttgaactttatatga

SEQ ID NO: 114933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttgaactttatatgaaga

SEQ ID NO: 114934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaactttatatgaagactt

SEQ ID NO: 114935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaactttatatgaagacttg

SEQ ID NO: 114936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aactttatatgaagacttgc

SEQ ID NO: 114937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatatgaagacttgcaaaat

SEQ ID NO: 114938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatgaagacttgcaaaata

SEQ ID NO: 114939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatgaagacttgcaaaatat

SEQ ID NO: 114940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcaaaatattttttaattag

SEQ ID NO: 114941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaaatattttttaattaga

SEQ ID NO: 114942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaattagacaaagtcatg

SEQ ID NO: 114943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaattagacaaagtcatgt

SEQ ID NO: 114944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattagacaaagtcatgtg

SEQ ID NO: 114945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattagacaaagtcatgtgg

SEQ ID NO: 114946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attagacaaagtcatgtggc

SEQ ID NO: 114947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gacaaagtcatgtggctcaa

SEQ ID NO: 114948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagaactatcattaagactt

SEQ ID NO: 114949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcattaagacttttttcttt

SEQ ID NO: 114950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agacttttttcttttttatt

SEQ ID NO: 114951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttcttttttattcattga

SEQ ID NO: 114952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcttttttattcattgaa

SEQ ID NO: 114953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttttttattcattgaat

SEQ ID NO: 114954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttttttattcattgaata

SEQ ID NO: 114955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttttattcattgaatat

SEQ ID NO: 114956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttttattcattgaatatt

SEQ ID NO: 114957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttattcattgaatattgc

SEQ ID NO: 114958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttattcattgaatattgct

SEQ ID NO: 114959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattcattgaatattgctg

SEQ ID NO: 114960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattcattgaatattgctga

SEQ ID NO: 114961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attcattgaatattgctgaa

SEQ ID NO: 114962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcattgaatattgctgaac

SEQ ID NO: 114963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attgaatattgctgaacagg

SEQ ID NO: 114964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatattgctgaacagggtca

SEQ ID NO: 114965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgaacagggtcaaaagcaa

SEQ ID NO: 114966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacagggtcaaaagcaaata

SEQ ID NO: 114967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caacacttggtttatcttct

SEQ ID NO: 114968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtttatcttctgagaaaca

SEQ ID NO: 114969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtttatcttctgagaaacat

SEQ ID NO: 114970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttctgagaaacatttaa

SEQ ID NO: 114971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttctgagaaacatttaaa

SEQ ID NO: 114972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgagaaacatttaaatatc

SEQ ID NO: 114973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgagaaacatttaaatatca

SEQ ID NO: 114974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaaacatttaaatatcatt

SEQ ID NO: 114975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatatcattaatgtaatct

SEQ ID NO: 114976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatatcattaatgtaatctc

SEQ ID NO: 114977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgtaatctctgaacagaat

SEQ ID NO: 114978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgaacagaatacaagaatga

SEQ ID NO: 114979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacagaatacaagaatgatc

SEQ ID NO: 114980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttcaagcaaagaaatatt

SEQ ID NO: 114981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttcaagcaaagaaatatta

SEQ ID NO: 114982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caagcaaagaaatattacag

SEQ ID NO: 114983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagcaaagaaatattacagt

SEQ ID NO: 114984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagtctctccagagttttag

SEQ ID NO: 114985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tccagagttttagagactct

SEQ ID NO: 114986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagagttttagagactctgt

SEQ ID NO: 114987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagagactctgtgtgcctgg

SEQ ID NO: 114988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agagactctgtgtgcctggt

SEQ ID NO: 114989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagactctgtgtgcctggta

SEQ ID NO: 114990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtgtgcctggtatggctct

SEQ ID NO: 114991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtgcctggtatggctctga

SEQ ID NO: 114992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtatggctctgaacatacta

SEQ ID NO: 114993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgaacatactatttggaaaa

SEQ ID NO: 114994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacatactatttggaaaacg

SEQ ID NO: 114995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttggaaaacggtattcttg

SEQ ID NO: 114996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaaaacggtattcttgaag

SEQ ID NO: 114997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaaacggtattcttgaagt

SEQ ID NO: 114998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgaagtcaaatattggaag

SEQ ID NO: 114999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaagtcaaatattggaagca

SEQ ID NO: 115000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagtcaaatattggaagcag

SEQ ID NO: 115001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaagcagacatcaggaaaat

SEQ ID NO: 115002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgggggacttcctttcat

SEQ ID NO: 115003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggggacttcctttcatccc

SEQ ID NO: 115004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggggacttcctttcatcccc

SEQ ID NO: 115005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctttcatccccaaggtact

SEQ ID NO: 115006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttcatccccaaggtacta

SEQ ID NO: 115007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcatccccaaggtactatga

SEQ ID NO: 115008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catccccaaggtactatgaa

SEQ ID NO: 115009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atccccaaggtactatgaaa

SEQ ID NO: 115010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgaaaacccttcacataggg

SEQ ID NO: 115011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacatagggaaaatctatag

SEQ ID NO: 115012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acatagggaaaatctatagg

SEQ ID NO: 115013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taggatgaggtgggaagtgg

SEQ ID NO: 115014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctaagtgttcacagtaaa

SEQ ID NO: 115015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctaagtgttcacagtaaaa

SEQ ID NO: 115016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtgttcacagtaaaaattg

SEQ ID NO: 115017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acagtaaaaattgtaaatcc

SEQ ID NO: 115018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaatcctctaaaaaatcac

SEQ ID NO: 115019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taaaaaatcactgaagtaaa

SEQ ID NO: 115020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaaatcactgaagtaaaca

SEQ ID NO: 115021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagtaaacaccaacactaat

SEQ ID NO: 115022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttttacctaataactaaa

SEQ ID NO: 115023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttacctaataactaaaagga

SEQ ID NO: 115024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacctaataactaaaaggaa

SEQ ID NO: 115025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acctaataactaaaaggaaa

SEQ ID NO: 115026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctaataactaaaaggaaaa

SEQ ID NO: 115027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ataactaaaaggaaaaaatg

SEQ ID NO: 115028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaggaaaaaatgtgagttg

SEQ ID NO: 115029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgcccattatattagactgg

SEQ ID NO: 115030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattagactggaaaaggtct

SEQ ID NO: 115031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gactggaaaaggtctcagtg

SEQ ID NO: 115032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaaaggtctcagtggcctc

SEQ ID NO: 115033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agtggcctctattaccttct

SEQ ID NO: 115034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tattaccttcttggccacat

SEQ ID NO: 115035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttaccttcttggccacataa

SEQ ID NO: 115036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccttcttggccacataacag

SEQ ID NO: 115037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttggccacataacaggtac

SEQ ID NO: 115038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttggccacataacaggtact

SEQ ID NO: 115039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggccacataacaggtactaa

SEQ ID NO: 115040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gccacataacaggtactaaa

SEQ ID NO: 115041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatactccaaactgcagttc

SEQ ID NO: 115042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caaactgcagttcccaaatg

SEQ ID NO: 115043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagttcccaaatgatttatt

SEQ ID NO: 115044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaaatgatttattagtgtc

SEQ ID NO: 115045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attagtgtcagggcaccaat

SEQ ID NO: 115046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttagtgtcagggcaccaatt

SEQ ID NO: 115047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgtcagggcaccaattcta

SEQ ID NO: 115048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattgtggctcagttagagt

SEQ ID NO: 115049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgtggctcagttagagtat

SEQ ID NO: 115050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggctcagttagagtatgtg

SEQ ID NO: 115051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agttagagtatgtgcatatt

SEQ ID NO: 115052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagtatgtgcatattatgtc

SEQ ID NO: 115053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtccatataattttgtaat

SEQ ID NO: 115054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaatatgttgtgcttttg

SEQ ID NO: 115055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaatatgttgtgcttttgt

SEQ ID NO: 115056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatatgttgtgcttttgta

SEQ ID NO: 115057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgcttttgtaataattaatg

SEQ ID NO: 115058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgtaataattaatgtttat

SEQ ID NO: 115059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaataattaatgtttatc

SEQ ID NO: 115060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaataattaatgtttatct

SEQ ID NO: 115061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taataattaatgtttatctt

SEQ ID NO: 115062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgtttatcttatatatgaa

SEQ ID NO: 115063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttatatatgaaagctat

SEQ ID NO: 115064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttatatatgaaagctata

SEQ ID NO: 115065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atatatgaaagctatattta

SEQ ID NO: 115066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatatgaaagctatatttat

SEQ ID NO: 115067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatttatttaagagaataag

SEQ ID NO: 115068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttaagagaataagttatt

SEQ ID NO: 115069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaagagaataagttattc

SEQ ID NO: 115070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagagaataagttattctct

SEQ ID NO: 115071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agagaataagttattctctt

SEQ ID NO: 115072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctcttaaaaatatctccc

SEQ ID NO: 115073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttaaaaatatctcccaga

SEQ ID NO: 115074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaaaaatatctcccagata

SEQ ID NO: 115075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaaatatctcccagataat

SEQ ID NO: 115076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatatctcccagataatt

SEQ ID NO: 115077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccagataattcctttaaaca

SEQ ID NO: 115078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttaaacagtatgtttcct

SEQ ID NO: 115079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaacagtatgtttcctttg

SEQ ID NO: 115080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaacagtatgtttcctttga

SEQ ID NO: 115081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacagtatgtttcctttgat

SEQ ID NO: 115082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctttgataacttttgacat

SEQ ID NO: 115083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttgataacttttgacatc

SEQ ID NO: 115084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgataacttttgacatctct

SEQ ID NO: 115085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gataacttttgacatctctt

SEQ ID NO: 115086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataacttttgacatctcttg

SEQ ID NO: 115087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgacatctcttgtagaaag

SEQ ID NO: 115088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgacatctcttgtagaaagc

SEQ ID NO: 115089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacatctcttgtagaaagca

SEQ ID NO: 115090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acatctcttgtagaaagcaa

SEQ ID NO: 115091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgtagaaagcaagtagtgt

SEQ ID NO: 115092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtagaaagcaagtagtgttt

SEQ ID NO: 115093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagaaagcaagtagtgttta

SEQ ID NO: 115094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttgtttgtttctttaatc

SEQ ID NO: 115095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttgtttgtttctttaatct

SEQ ID NO: 115096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtttgtttctttaatcttga

SEQ ID NO: 115097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgtttctttaatcttgat

SEQ ID NO: 115098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttctttaatcttgattag

SEQ ID NO: 115099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttctttaatcttgattaga

SEQ ID NO: 115100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttaatcttgattagaggg

SEQ ID NO: 115101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttaatcttgattagaggga

SEQ ID NO: 115102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taatcttgattagagggact

SEQ ID NO: 115103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatcttgattagagggacta

SEQ ID NO: 115104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcttgattagagggactat

SEQ ID NO: 115105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gattagagggactatgatat

SEQ ID NO: 115106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attagagggactatgatatg

SEQ ID NO: 115107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagggactatgatatgacat

SEQ ID NO: 115108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgatatgacattttcttatt

SEQ ID NO: 115109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttatttcaaggagcagga

SEQ ID NO: 115110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttatttcaaggagcaggaa

SEQ ID NO: 115111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatttcaaggagcaggaaa

SEQ ID NO: 115112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttcaaggagcaggaaaat

SEQ ID NO: 115113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcaaggagcaggaaaata

SEQ ID NO: 115114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaggagcaggaaaatagct

SEQ ID NO: 115115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaggagcaggaaaatagcta

SEQ ID NO: 115116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacgctcacaactctatatt

SEQ ID NO: 115117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acaactctatattttcttat

SEQ ID NO: 115118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatattttcttatttcaagg

SEQ ID NO: 115119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tattttcttatttcaaggag

SEQ ID NO: 115120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttatttcaaggagcagga

SEQ ID NO: 115121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttatttcaaggagcaggaa

SEQ ID NO: 115122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatttcaaggagcaggaaa

SEQ ID NO: 115123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttcaaggagcaggaaaat

SEQ ID NO: 115124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcaaggagcaggaaaata

SEQ ID NO: 115125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaggagcaggaaaatagct

SEQ ID NO: 115126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaggagcaggaaaatagcta

SEQ ID NO: 115127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catgctcacaactctataat

SEQ ID NO: 115128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acaactctataataatttca

SEQ ID NO: 115129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tataataatttcaggctgtt

SEQ ID NO: 115130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taataatttcaggctgtttt

SEQ ID NO: 115131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caggctgttttgcattccat

SEQ ID NO: 115132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggctgttttgcattccatc

SEQ ID NO: 115133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttgcattccatcactgag

SEQ ID NO: 115134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcattccatcactgagcct

SEQ ID NO: 115135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcattccatcactgagcctc

SEQ ID NO: 115136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattccatcactgagcctct

SEQ ID NO: 115137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catcactgagcctcttacct

SEQ ID NO: 115138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agcctcttacctgtaaataa

SEQ ID NO: 115139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttacctgtaaataacttaat

SEQ ID NO: 115140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acctgtaaataacttaatct

SEQ ID NO: 115141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctgtaaataacttaatctt

SEQ ID NO: 115142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaataacttaatcttattt

SEQ ID NO: 115143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatcttatttcgataaaatt

SEQ ID NO: 115144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcttatttcgataaaatta

SEQ ID NO: 115145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttcgataaaattacaaca

SEQ ID NO: 115146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcgataaaattacaacaa

SEQ ID NO: 115147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgataaaattacaacaatta

SEQ ID NO: 115148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gataaaattacaacaattag

SEQ ID NO: 115149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caacaattagccaggtgtgg

SEQ ID NO: 115150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccaggtgtggtgtgggcgc

SEQ ID NO: 115151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caatctcagctactcaggag

SEQ ID NO: 115152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agctactcaggaggctgagg

SEQ ID NO: 115153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcaggaggctgaggcagga

SEQ ID NO: 115154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggaggctgaggcaggagaa

SEQ ID NO: 115155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggcaggagaattacttgaa

SEQ ID NO: 115156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttgaacccagcaggcagag

SEQ ID NO: 115157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaacccagcaggcagaggtt

SEQ ID NO: 115158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacccagcaggcagaggttg

SEQ ID NO: 115159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagtgagccgagatcgcgcc

SEQ ID NO: 115160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cactccagcctgaaccagag

SEQ ID NO: 115161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagcctgaaccagagagcgg

SEQ ID NO: 115162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaccagagagcgggactcca

SEQ ID NO: 115163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catctcaaataaataaataa

SEQ ID NO: 115164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaataaataaataaatttat

SEQ ID NO: 115165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttaaaattggtcca

SEQ ID NO: 115166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttaaaattggtccaa

SEQ ID NO: 115167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttaaaattggtccaatta

SEQ ID NO: 115168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaaaattggtccaattaa

SEQ ID NO: 115169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaattggtccaattaatca

SEQ ID NO: 115170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattggtccaattaatcat

SEQ ID NO: 115171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtccaattaatcatttggaa

SEQ ID NO: 115172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcatttggaagatctgcca

SEQ ID NO: 115173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaagatctgccaaaatctg

SEQ ID NO: 115174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaagatctgccaaaatctga

SEQ ID NO: 115175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccaaaatctgaatgagattg

SEQ ID NO: 115176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatgagattgagtcagtata

SEQ ID NO: 115177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtcagtataaatatttaag

SEQ ID NO: 115178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagacagtggacaaatgtaa

SEQ ID NO: 115179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agacagtggacaaatgtaaa

SEQ ID NO: 115180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattgatgctaactgttgt

SEQ ID NO: 115181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattgatgctaactgttgta

SEQ ID NO: 115182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgatgctaactgttgtaa

SEQ ID NO: 115183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgatgctaactgttgtaaa

SEQ ID NO: 115184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgctaactgttgtaaaatg

SEQ ID NO: 115185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actgttgtaaaatgaaatac

SEQ ID NO: 115186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgtaaaatgaaatactgct

SEQ ID NO: 115187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaaatgaaatactgctttg

SEQ ID NO: 115188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctttgaaaatgtcacttctc

SEQ ID NO: 115189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaaaatgtcacttctctag

SEQ ID NO: 115190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaatgtcacttctctaga

SEQ ID NO: 115191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaatgtcacttctctagaa

SEQ ID NO: 115192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctctagaaacacatagtgat

SEQ ID NO: 115193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctagaaacacatagtgatt

SEQ ID NO: 115194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagaaacacatagtgatttt

SEQ ID NO: 115195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaacacatagtgatttttt

SEQ ID NO: 115196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcctgcaggtaaaatctt

SEQ ID NO: 115197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcctgcaggtaaaatcttg

SEQ ID NO: 115198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctgcaggtaaaatcttga

SEQ ID NO: 115199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgcaggtaaaatcttgac

SEQ ID NO: 115200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgcaggtaaaatcttgact

SEQ ID NO: 115201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caggtaaaatcttgactgaa

SEQ ID NO: 115202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gactgaagtaccattaattt

SEQ ID NO: 115203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actgaagtaccattaatttt

SEQ ID NO: 115204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagtaccattaatttttaaa

SEQ ID NO: 115205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttttaaagcattctcaag

SEQ ID NO: 115206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaagcattctcaaggcac

SEQ ID NO: 115207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaagcattctcaaggcacc

SEQ ID NO: 115208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagcattctcaaggcacca

SEQ ID NO: 115209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagcattctcaaggcaccat

SEQ ID NO: 115210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaaggcaccatagaatcag

SEQ ID NO: 115211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaggcaccatagaatcagaa

SEQ ID NO: 115212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaagtttatttaaatcata

SEQ ID NO: 115213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttaaatcatagttaacat

SEQ ID NO: 115214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaaatcatagttaacatc

SEQ ID NO: 115215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatcatagttaacatcaac

SEQ ID NO: 115216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatcatagttaacatcaaca

SEQ ID NO: 115217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatcaacaacgataactca

SEQ ID NO: 115218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attgacaatgtgtaccattg

SEQ ID NO: 115219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acaatgtgtaccattgatac

SEQ ID NO: 115220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atactatgtgatgagaatgg

SEQ ID NO: 115221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtgatgagaatggcctttt

SEQ ID NO: 115222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttacatatgtgatcttcctt

SEQ ID NO: 115223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacatatgtgatcttccttc

SEQ ID NO: 115224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatatgtgatcttccttcc

SEQ ID NO: 115225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catatgtgatcttccttccc

SEQ ID NO: 115226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttcccaaaacttatagcc

SEQ ID NO: 115227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttcccaaaacttatagcct

SEQ ID NO: 115228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccaaaacttatagccttaa

SEQ ID NO: 115229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaaaacttatagccttaat

SEQ ID NO: 115230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atagccttaatctaaccatg

SEQ ID NO: 115231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagccttaatctaaccatga

SEQ ID NO: 115232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatctaaccatgagaaaaat

SEQ ID NO: 115233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atctaaccatgagaaaaata

SEQ ID NO: 115234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
accatgagaaaaatatcaga

SEQ ID NO: 115235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggaacattctacaaaatac

SEQ ID NO: 115236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacaaaatacctaacctata

SEQ ID NO: 115237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaaatacctaacctatact

SEQ ID NO: 115238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acctatactcactcaaagta

SEQ ID NO: 115239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tactcactcaaagtatcaac

SEQ ID NO: 115240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actcaaagtatcaacatcat

SEQ ID NO: 115241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaagtatcaacatcatcaaa

SEQ ID NO: 115242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaaattgcgacagcctaga

SEQ ID NO: 115243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cgacagcctagagatgctta

SEQ ID NO: 115244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gagatgcttaaggtgatatg

SEQ ID NO: 115245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaggtgatatgatggtatga

SEQ ID NO: 115246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggtgatatgatggtatgat

SEQ ID NO: 115247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgtaatgtggtagcctgg

SEQ ID NO: 115248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtgagatcttgaaagagaa

SEQ ID NO: 115249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaagagaaaaaggaaatta

SEQ ID NO: 115250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaagagaaaaaggaaattag

SEQ ID NO: 115251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgaaaaactaaggaactct

SEQ ID NO: 115252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aggaactctgaatagggtaa

SEQ ID NO: 115253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgaatagggtaagggcattt

SEQ ID NO: 115254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatagggtaagggcatttgt

SEQ ID NO: 115255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttaataataatgatgtatc

SEQ ID NO: 115256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaataataatgatgtatca

SEQ ID NO: 115257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataataatgatgtatcacat

SEQ ID NO: 115258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttaattgtgacaaatgcg

SEQ ID NO: 115259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttaattgtgacaaatgcgc

SEQ ID NO: 115260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaattgtgacaaatgcgcc

SEQ ID NO: 115261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attgtgacaaatgcgccata

SEQ ID NO: 115262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgacaaatgcgccatactaa

SEQ ID NO: 115263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atataaactgttaataacag

SEQ ID NO: 115264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttaataacaggggaaactgg

SEQ ID NO: 115265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataacaggggaaactggatg

SEQ ID NO: 115266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatgtggggtatattgaaac

SEQ ID NO: 115267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaactgtccttactatctgc

SEQ ID NO: 115268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tccttactatctgcaccatt

SEQ ID NO: 115269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actatctgcaccatttttcc

SEQ ID NO: 115270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctatctgcaccatttttcca

SEQ ID NO: 115271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctgcaccatttttccataa

SEQ ID NO: 115272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caccatttttccataaatct

SEQ ID NO: 115273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccataaatctattccaag

SEQ ID NO: 115274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccataaatctattccaaga

SEQ ID NO: 115275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccataaatctattccaagac

SEQ ID NO: 115276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cataaatctattccaagaca

SEQ ID NO: 115277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttccaagacaaaagtttaag

SEQ ID NO: 115278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caagacaaaagtttaagcaa

SEQ ID NO: 115279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagcaaaaggaaatcacaga

SEQ ID NO: 115280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcaaaaggaaatcacagat

SEQ ID NO: 115281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctaatattaaataaaggt

SEQ ID NO: 115282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taatattaaataaaggtaat

SEQ ID NO: 115283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atattaaataaaggtaataa

SEQ ID NO: 115284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataaaggtaataatagctc

SEQ ID NO: 115285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agtgaatttgaatttatcag

SEQ ID NO: 115286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaatttatcaggtaaatgca

SEQ ID NO: 115287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatttatcaggtaaatgcat

SEQ ID NO: 115288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcaggtaaatgcattgcca

SEQ ID NO: 115289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaggtaaatgcattgccat

SEQ ID NO: 115290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccattatctatattatctat

SEQ ID NO: 115291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctatattatctataatata

SEQ ID NO: 115292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tattatctataatataccta

SEQ ID NO: 115293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctataatatacctaagtga

SEQ ID NO: 115294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatatacctaagtgataat

SEQ ID NO: 115295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtgataatagacataaatt

SEQ ID NO: 115296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaccacttttaattaaaat

SEQ ID NO: 115297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaccacttttaattaaaatg

SEQ ID NO: 115298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaattaaaatgaattacaa

SEQ ID NO: 115299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattaaaatgaattacaat

SEQ ID NO: 115300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattaaaatgaattacaatt

SEQ ID NO: 115301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attaaaatgaattacaatta

SEQ ID NO: 115302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgaattacaattaatac

SEQ ID NO: 115303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caattaatacattaaaaata

SEQ ID NO: 115304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atacattaaaaatacatatt

SEQ ID NO: 115305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatacatattttacacag

SEQ ID NO: 115306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacacagtacaaaatagcat

SEQ ID NO: 115307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acacagtacaaaatagcatt

SEQ ID NO: 115308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacagtacaaaatagcattg

SEQ ID NO: 115309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttgatcaataggagatcc

SEQ ID NO: 115310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgatcaataggagatccatt

SEQ ID NO: 115311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatcaataggagatccatta

SEQ ID NO: 115312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcaataggagatccattag

SEQ ID NO: 115313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaatgctgatcagttttct

SEQ ID NO: 115314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atcagttttcttaaagtaat

SEQ ID NO: 115315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttaaagtaatcatgcctg

SEQ ID NO: 115316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttaaagtaatcatgcctgg

SEQ ID NO: 115317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaaagtaatcatgcctggg

SEQ ID NO: 115318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaagtaatcatgcctgggag

SEQ ID NO: 115319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtaatcatgcctgggagg

SEQ ID NO: 115320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaggataattttctataaa

SEQ ID NO: 115321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctataaatgcactctcctg

SEQ ID NO: 115322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctataaatgcactctcctgg

SEQ ID NO: 115323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tataaatgcactctcctggg

SEQ ID NO: 115324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaatgcactctcctgggtc

SEQ ID NO: 115325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcctgggtcaggaatgagct

SEQ ID NO: 115326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgggtcaggaatgagctta

SEQ ID NO: 115327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtcaggaatgagcttatga

SEQ ID NO: 115328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgacttataaacatagaac

SEQ ID NO: 115329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgacttataaacatagaact

SEQ ID NO: 115330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataaacatagaactaaactg

SEQ ID NO: 115331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaacatagaactaaactgg

SEQ ID NO: 115332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aactggagtcacaatgtctg

SEQ ID NO: 115333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagtcacaatgtctgagtcc

SEQ ID NO: 115334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtcctaattatacttgaga

SEQ ID NO: 115335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attatacttgagagtcatta

SEQ ID NO: 115336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacttgagagtcattatgtc

SEQ ID NO: 115337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagagtcattatgtcttatt

SEQ ID NO: 115338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agagtcattatgtcttatta

SEQ ID NO: 115339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtcttattataataggcta

SEQ ID NO: 115340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attataataggctaaaaaaa

SEQ ID NO: 115341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttataataggctaaaaaaat

SEQ ID NO: 115342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taataggctaaaaaaataca

SEQ ID NO: 115343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaaaatacacttatgaggg

SEQ ID NO: 115344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgagggaatctgtgtgtat

SEQ ID NO: 115345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgagggaatctgtgtgtatt

SEQ ID NO: 115346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtgtattttcttttagaat

SEQ ID NO: 115347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttttagaataagtacaat

SEQ ID NO: 115348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttagaataagtacaatt

SEQ ID NO: 115349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttagaataagtacaattt

SEQ ID NO: 115350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttagaataagtacaatttaa

SEQ ID NO: 115351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagaataagtacaatttaac

SEQ ID NO: 115352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaataagtacaatttaact

SEQ ID NO: 115353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaataagtacaatttaactc

SEQ ID NO: 115354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactccctcaaccatggtaa

SEQ ID NO: 115355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actccctcaaccatggtaag

SEQ ID NO: 115356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctcaaccatggtaagcata

SEQ ID NO: 115357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaccatggtaagcatactaa

SEQ ID NO: 115358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatatcttttaagttgttaa

SEQ ID NO: 115359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaagttgttaaattgaagc

SEQ ID NO: 115360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagttgttaaattgaagct

SEQ ID NO: 115361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagttgttaaattgaagctt

SEQ ID NO: 115362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agttgttaaattgaagcttt

SEQ ID NO: 115363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaaattgaagctttattac

SEQ ID NO: 115364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattgaagctttattacata

SEQ ID NO: 115365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagctttattacatatccat

SEQ ID NO: 115366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattacatatccatcttaat

SEQ ID NO: 115367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attacatatccatcttaatg

SEQ ID NO: 115368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttacatatccatcttaatga

SEQ ID NO: 115369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catatccatcttaatgatgc

SEQ ID NO: 115370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatgatgccgttaaggtaca

SEQ ID NO: 115371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgatgccgttaaggtacaa

SEQ ID NO: 115372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggtacaaaaggctgacttt

SEQ ID NO: 115373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acttttgatttctgtgttac

SEQ ID NO: 115374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgatttctgtgttacttta

SEQ ID NO: 115375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgatttctgtgttactttag

SEQ ID NO: 115376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatttctgtgttactttagg

SEQ ID NO: 115377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atttctgtgttactttagga

SEQ ID NO: 115378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtgttactttaggaactg

SEQ ID NO: 115379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtgttactttaggaactgt

SEQ ID NO: 115380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgttactttaggaactgtga

SEQ ID NO: 115381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttaggaactgtgaggtaa

SEQ ID NO: 115382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taggaactgtgaggtaacat

SEQ ID NO: 115383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggaactgtgaggtaacata

SEQ ID NO: 115384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaactgtgaggtaacatag

SEQ ID NO: 115385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgaggtaacatagagataaa

SEQ ID NO: 115386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gactctgagattctcatttt

SEQ ID NO: 115387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actctgagattctcatttta

SEQ ID NO: 115388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgagattctcattttactga

SEQ ID NO: 115389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agattctcattttactgagc

SEQ ID NO: 115390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcattttactgagctctgaa

SEQ ID NO: 115391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attttactgagctctgaaca

SEQ ID NO: 115392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tactgagctctgaacacctg

SEQ ID NO: 115393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actgagctctgaacacctga

SEQ ID NO: 115394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgagctctgaacacctgat

SEQ ID NO: 115395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agctctgaacacctgataac

SEQ ID NO: 115396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgaacacctgataacatcat

SEQ ID NO: 115397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacacctgataacatcatca

SEQ ID NO: 115398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ataacatcatcagagcaaga

SEQ ID NO: 115399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cactctggctgacaaggata

SEQ ID NO: 115400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tggctgacaaggatacgctt

SEQ ID NO: 115401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctgacaaggatacgcttaa

SEQ ID NO: 115402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acaaggatacgcttaaccct

SEQ ID NO: 115403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaccctggtttataactaca

SEQ ID NO: 115404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
accctggtttataactacaa

SEQ ID NO: 115405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtttataactacaaaagccc

SEQ ID NO: 115406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataactacaaaagccccttt

SEQ ID NO: 115407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taactacaaaagcccctttt

SEQ ID NO: 115408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaaagccccttttgtcaat

SEQ ID NO: 115409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgtcaataatattttaaat

SEQ ID NO: 115410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtcaataatattttaaatt

SEQ ID NO: 115411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcaataatattttaaatta

SEQ ID NO: 115412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaataatattttaaattac

SEQ ID NO: 115413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaattactctcctatgttc

SEQ ID NO: 115414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattactctcctatgttcg

SEQ ID NO: 115415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattactctcctatgttcga

SEQ ID NO: 115416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctctcctatgttcgataaca

SEQ ID NO: 115417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcctatgttcgataacatca

SEQ ID NO: 115418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctatgttcgataacatcacc

SEQ ID NO: 115419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgttcgataacatcaccttc

SEQ ID NO: 115420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gataacatcaccttcataac

SEQ ID NO: 115421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cataacttatctactcataa

SEQ ID NO: 115422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataacttatctactcataac

SEQ ID NO: 115423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atctactcataacataagac

SEQ ID NO: 115424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctactcataacataagact

SEQ ID NO: 115425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcataacataagacttccc

SEQ ID NO: 115426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataacataagacttcccatg

SEQ ID NO: 115427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccatgataaaagagaaata

SEQ ID NO: 115428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccatgataaaagagaaatat

SEQ ID NO: 115429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttccagtatgaactctta

SEQ ID NO: 115430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttccagtatgaactcttat

SEQ ID NO: 115431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccagtatgaactcttatagg

SEQ ID NO: 115432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagtatgaactcttataggc

SEQ ID NO: 115433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttataggccttctcccatga

SEQ ID NO: 115434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataggccttctcccatgaaa

SEQ ID NO: 115435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taggccttctcccatgaaaa

SEQ ID NO: 115436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcccatgaaaacagaaaaa

SEQ ID NO: 115437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcccatgaaaacagaaaaat

SEQ ID NO: 115438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccatgaaaacagaaaaattt

SEQ ID NO: 115439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccagatggatctgaaaactc

SEQ ID NO: 115440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagatggatctgaaaactct

SEQ ID NO: 115441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaactctgttctatgtctt

SEQ ID NO: 115442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgttctatgtcttggcacca

SEQ ID NO: 115443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttctatgtcttggcaccaag

SEQ ID NO: 115444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatgtcttggcaccaagaaa

SEQ ID NO: 115445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtcttggcaccaagaaaat

SEQ ID NO: 115446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcaccaagaaaatattgga

SEQ ID NO: 115447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcaccaagaaaatattggag

SEQ ID NO: 115448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagtccttcctacacctggc

SEQ ID NO: 115449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctacacctggcctccgatt

SEQ ID NO: 115450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctacacctggcctccgattg

SEQ ID NO: 115451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacctggcctccgattgaat

SEQ ID NO: 115452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcctccgattgaataagtga

SEQ ID NO: 115453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cgattgaataagtgaaatat

SEQ ID NO: 115454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aataagtgaaatatcaagat

SEQ ID NO: 115455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatatgtcaataacaagata

SEQ ID NO: 115456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatgtcaataacaagataaa

SEQ ID NO: 115457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaacattcaaagacaataag

SEQ ID NO: 115458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaagacaataagaagtacaa

SEQ ID NO: 115459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtcattgaatagctctaca

SEQ ID NO: 115460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtcattgaatagctctacag

SEQ ID NO: 115461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatagctctacagtttagat

SEQ ID NO: 115462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tacagtttagataagaaagt

SEQ ID NO: 115463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagtttagataagaaagtca

SEQ ID NO: 115464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agataagaaagtcaaaggtg

SEQ ID NO: 115465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gataagaaagtcaaaggtgc

SEQ ID NO: 115466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatctggagaatacagggga

SEQ ID NO: 115467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagaatacaggggaaaaata

SEQ ID NO: 115468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaccaagtctatatccatt

SEQ ID NO: 115469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaccaagtctatatccattc

SEQ ID NO: 115470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatccattcctatgtgctcc

SEQ ID NO: 115471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctatgtgctccttgaattat

SEQ ID NO: 115472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtgctccttgaattataag

SEQ ID NO: 115473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttgaattataagggtatct

SEQ ID NO: 115474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaattataagggtatctcag

SEQ ID NO: 115475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattataagggtatctcagt

SEQ ID NO: 115476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taagggtatctcagtatttc

SEQ ID NO: 115477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agtatttctcattttactaa

SEQ ID NO: 115478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcattttactaatctaaat

SEQ ID NO: 115479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcattttactaatctaaata

SEQ ID NO: 115480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attttactaatctaaatacc

SEQ ID NO: 115481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tactaatctaaatacctgat

SEQ ID NO: 115482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actaatctaaatacctgata

SEQ ID NO: 115483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaatctaaatacctgataa

SEQ ID NO: 115484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atctaaatacctgataacat

SEQ ID NO: 115485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatacctgataacatctttg

SEQ ID NO: 115486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ataacatctttggaggaagg

SEQ ID NO: 115487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggaggaaggaaatagacag

SEQ ID NO: 115488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaggaaggaaatagacagc

SEQ ID NO: 115489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaggaaggaaatagacagct

SEQ ID NO: 115490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taccctagctgtcagggtta

SEQ ID NO: 115491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccctagctgtcagggttaca

SEQ ID NO: 115492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctgtcagggttacacttat

SEQ ID NO: 115493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcagggttacacttataaat

SEQ ID NO: 115494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacttataaatttgattcaa

SEQ ID NO: 115495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataaatttgattcaatcctt

SEQ ID NO: 115496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaatttgattcaatccttg

SEQ ID NO: 115497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gattcaatccttggcaggat

SEQ ID NO: 115498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attcaatccttggcaggatg

SEQ ID NO: 115499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatccttggcaggatgtcta

SEQ ID NO: 115500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcaggatgtctacagcatt

SEQ ID NO: 115501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcaggatgtctacagcattt

SEQ ID NO: 115502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagcatttatgttccaagcc

SEQ ID NO: 115503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgttccaagccaggatttt

SEQ ID NO: 115504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgttccaagccaggattttg

SEQ ID NO: 115505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caagccaggattttgtgtca

SEQ ID NO: 115506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgtcaagaataaatgcta

SEQ ID NO: 115507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgtcaagaataaatgctac

SEQ ID NO: 115508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtcaagaataaatgctaca

SEQ ID NO: 115509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacaacacagaaaataccaa

SEQ ID NO: 115510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggactgttctaggcaagctt

SEQ ID NO: 115511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gactgttctaggcaagctta

SEQ ID NO: 115512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttctaggcaagcttagatat

SEQ ID NO: 115513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taggcaagcttagatatatg

SEQ ID NO: 115514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggcaagcttagatatatgat

SEQ ID NO: 115515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agatatatgatgatcttacc

SEQ ID NO: 115516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatatatgatgatcttacca

SEQ ID NO: 115517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
accattgagagatccttgga

SEQ ID NO: 115518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccattgagagatccttggag

SEQ ID NO: 115519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agagatccttggagaaatag

SEQ ID NO: 115520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggagaaatagccaaatagga

SEQ ID NO: 115521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagaaatagccaaataggac

SEQ ID NO: 115522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcaccacctcataatacttt

SEQ ID NO: 115523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataatacttttcttttttta

SEQ ID NO: 115524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctttttttatgagagcat

SEQ ID NO: 115525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttttttatgagagcata

SEQ ID NO: 115526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttttttatgagagcatat

SEQ ID NO: 115527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttttatgagagcatatt

SEQ ID NO: 115528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttatgagagcatattag

SEQ ID NO: 115529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttatgagagcatattaga

SEQ ID NO: 115530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttatgagagcatattagac

SEQ ID NO: 115531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatgagagcatattagact

SEQ ID NO: 115532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgagagcatattagacta

SEQ ID NO: 115533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgagagcatattagactaa

SEQ ID NO: 115534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgagagcatattagactaac

SEQ ID NO: 115535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gactaaccatcctactgact

SEQ ID NO: 115536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
accatcctactgactattct

SEQ ID NO: 115537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgactattctttatcaaag

SEQ ID NO: 115538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actattctttatcaaagtaa

SEQ ID NO: 115539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttctttatcaaagtaagcca

SEQ ID NO: 115540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttatcaaagtaagccatag

SEQ ID NO: 115541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatcaaagtaagccatagtt

SEQ ID NO: 115542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcaaagtaagccatagtta

SEQ ID NO: 115543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaaagtaagccatagttat

SEQ ID NO: 115544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgtgaacttttctgaaaga

SEQ ID NO: 115545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaacttttctgaaagattt

SEQ ID NO: 115546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctgaaagattttgtggct

SEQ ID NO: 115547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgaaagattttgtggctg

SEQ ID NO: 115548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaaagattttgtggctgc

SEQ ID NO: 115549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaaagattttgtggctgca

SEQ ID NO: 115550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaagattttgtggctgcaca

SEQ ID NO: 115551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtggctgcacaacagtgct

SEQ ID NO: 115552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtggctgcacaacagtgctg

SEQ ID NO: 115553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggctgcacaacagtgctgt

SEQ ID NO: 115554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cacaacagtgctgtagtaag

SEQ ID NO: 115555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagtaagcagatgtcatata

SEQ ID NO: 115556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcactagtgtttggaaatc

SEQ ID NO: 115557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtgtttggaaatcctgcact

SEQ ID NO: 115558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaaatcctgcactttgctt

SEQ ID NO: 115559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaatcctgcactttgctta

SEQ ID NO: 115560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cactttgcttaaataacatc

SEQ ID NO: 115561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcttaaataacatcctagg

SEQ ID NO: 115562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttaaataacatcctaggg

SEQ ID NO: 115563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttaaataacatcctaggga

SEQ ID NO: 115564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaataacatcctagggagtc

SEQ ID NO: 115565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataacatcctagggagtct

SEQ ID NO: 115566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gggagtcttggagcttgaga

SEQ ID NO: 115567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggagcttgagaacattcaga

SEQ ID NO: 115568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagcttgagaacattcagat

SEQ ID NO: 115569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagaacattcagataactaa

SEQ ID NO: 115570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaacattcagataactaaa

SEQ ID NO: 115571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agataactaaaggttcttga

SEQ ID NO: 115572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaggttcttgacttcaggct

SEQ ID NO: 115573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgacttcaggctgaagact

SEQ ID NO: 115574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacttcaggctgaagactgg

SEQ ID NO: 115575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acttcaggctgaagactggg

SEQ ID NO: 115576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caggctgaagactgggacca

SEQ ID NO: 115577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggctgaagactgggaccac

SEQ ID NO: 115578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagactgggaccactatggg

SEQ ID NO: 115579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaccactatgggttatctt

SEQ ID NO: 115580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgggttatcttcaaatattg

SEQ ID NO: 115581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttcaaatattgtttagca

SEQ ID NO: 115582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaatattgtttagcattgc

SEQ ID NO: 115583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaatattgtttagcattgca

SEQ ID NO: 115584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttagcattgcaattaaaat

SEQ ID NO: 115585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcattgcaattaaaattca

SEQ ID NO: 115586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcattgcaattaaaattcaa

SEQ ID NO: 115587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caattaaaattcaatgaaag

SEQ ID NO: 115588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattcaatgaaaggtctgt

SEQ ID NO: 115589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgaaaggtctgtgaaacc

SEQ ID NO: 115590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgaaaccccttgacaaaact

SEQ ID NO: 115591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacaaaacttttcattttct

SEQ ID NO: 115592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acaaaacttttcattttctg

SEQ ID NO: 115593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcattttctgtcttgagaa

SEQ ID NO: 115594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattttctgtcttgagaat

SEQ ID NO: 115595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattttctgtcttgagaatt

SEQ ID NO: 115596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attttctgtcttgagaattt

SEQ ID NO: 115597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgtcttgagaatttctgt

SEQ ID NO: 115598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtcttgagaatttctgtc

SEQ ID NO: 115599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtcttgagaatttctgtct

SEQ ID NO: 115600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcttgagaatttctgtctta

SEQ ID NO: 115601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagaatttctgtcttatttt

SEQ ID NO: 115602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaatttctgtcttattttg

SEQ ID NO: 115603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtcttattttgataaaaa

SEQ ID NO: 115604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtcttattttgataaaaat

SEQ ID NO: 115605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcttattttgataaaaataa

SEQ ID NO: 115606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attttgataaaaataaacac

SEQ ID NO: 115607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttgataaaaataaacaca

SEQ ID NO: 115608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgataaaaataaacacaata

SEQ ID NO: 115609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gataaaaataaacacaatat

SEQ ID NO: 115610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataaaaataaacacaatatt

SEQ ID NO: 115611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatattgcgtttataccaca

SEQ ID NO: 115612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atattgcgtttataccacag

SEQ ID NO: 115613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cgtttataccacagaaggag

SEQ ID NO: 115614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataccacagaaggaggcagc

SEQ ID NO: 115615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taccacagaaggaggcagct

SEQ ID NO: 115616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taatatgggcagaaagtatg

SEQ ID NO: 115617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatttttgaaaggtataaa

SEQ ID NO: 115618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatttttgaaaggtataaat

SEQ ID NO: 115619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgaaaggtataaattttct

SEQ ID NO: 115620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaaaggtataaattttctt

SEQ ID NO: 115621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaggtataaattttctta

SEQ ID NO: 115622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaggtataaattttcttat

SEQ ID NO: 115623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttataaacacaaggtctc

SEQ ID NO: 115624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttataaacacaaggtctca

SEQ ID NO: 115625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttataaacacaaggtctcac

SEQ ID NO: 115626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataaacacaaggtctcactc

SEQ ID NO: 115627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaacacaaggtctcactca

SEQ ID NO: 115628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actcactctgttgcccaggt

SEQ ID NO: 115629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actctgttgcccaggttgca

SEQ ID NO: 115630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgttgcccaggttgcagtgc

SEQ ID NO: 115631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgcccaggttgcagtgcaa

SEQ ID NO: 115632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccaggttgcagtgcaatac

SEQ ID NO: 115633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagtgcaatactgtgatcac

SEQ ID NO: 115634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgatcacggctcactggagc

SEQ ID NO: 115635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actggagcatcatcctcgtg

SEQ ID NO: 115636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagcatcatcctcgtgcact

SEQ ID NO: 115637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gtgcactcaagcgacctccc

SEQ ID NO: 115638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagcgacctcccaccttccc

SEQ ID NO: 115639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaccttcccaagtagctgg

SEQ ID NO: 115640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccaagtagctgggaccaca

SEQ ID NO: 115641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaagtagctgggaccacag

SEQ ID NO: 115642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaccacaggtgcgtgccac

SEQ ID NO: 115643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggctaattttttaaagcatt

SEQ ID NO: 115644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attttttaaagcattttttg

SEQ ID NO: 115645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaagcattttttgtaga

SEQ ID NO: 115646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaagcattttttgtagag

SEQ ID NO: 115647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaagcattttttgtagaga

SEQ ID NO: 115648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagcattttttgtagagac

SEQ ID NO: 115649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagcattttttgtagagaca

SEQ ID NO: 115650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgtagagacaaggtctca

SEQ ID NO: 115651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtagagacaaggtctcac

SEQ ID NO: 115652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtagagacaaggtctcacc

SEQ ID NO: 115653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtagagacaaggtctcacca

SEQ ID NO: 115654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagagacaaggtctcaccat

SEQ ID NO: 115655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
accatgttgcccaggctcgt

SEQ ID NO: 115656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccaggctcgtcttgaactc

SEQ ID NO: 115657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gtcttgaactcctgggctca

SEQ ID NO: 115658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaactcctgggctcaagtga

SEQ ID NO: 115659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aactcctgggctcaagtgat

SEQ ID NO: 115660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgggctcaagtgatctgcc

SEQ ID NO: 115661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggctcaagtgatctgccctc

SEQ ID NO: 115662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagtgatctgccctccttgg

SEQ ID NO: 115663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccctccttggcctcccaaag

SEQ ID NO: 115664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttggcctcccaaagtgctg

SEQ ID NO: 115665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcctcccaaagtgctgggg

SEQ ID NO: 115666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcctcccaaagtgctggggt

SEQ ID NO: 115667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaaagtgctggggttacag

SEQ ID NO: 115668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gggttacaggcatcaaccac

SEQ ID NO: 115669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caggcatcaaccactgagcc

SEQ ID NO: 115670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agcctggcacaattttttaa

SEQ ID NO: 115671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcacaattttttaaattgcc

SEQ ID NO: 115672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaattgccaacattcta

SEQ ID NO: 115673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaattgccaacattctac

SEQ ID NO: 115674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaattgccaacattctact

SEQ ID NO: 115675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattgccaacattctactt

SEQ ID NO: 115676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattgccaacattctactta

SEQ ID NO: 115677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccaacattctacttatcttg

SEQ ID NO: 115678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacttatcttgttttatctt

SEQ ID NO: 115679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttatcttgttttatcttac

SEQ ID NO: 115680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atcttgttttatcttactct

SEQ ID NO: 115681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttgttttatcttactctt

SEQ ID NO: 115682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttttatcttactcttcccc

SEQ ID NO: 115683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttatcttactcttcccct

SEQ ID NO: 115684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcttactcttcccctagt

SEQ ID NO: 115685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttactcttcccctagtc

SEQ ID NO: 115686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttactcttcccctagtct

SEQ ID NO: 115687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actcttcccctagtctagat

SEQ ID NO: 115688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcttcccctagtctagatt

SEQ ID NO: 115689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcccctagtctagattcag

SEQ ID NO: 115690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccctagtctagattcagta

SEQ ID NO: 115691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccctagtctagattcagtaa

SEQ ID NO: 115692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtctagattcagtaaaaaca

SEQ ID NO: 115693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gattcagtaaaaacaatggt

SEQ ID NO: 115694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtaaaaacaatggttgtaa

SEQ ID NO: 115695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatttattatatttaggga

SEQ ID NO: 115696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attatatttagggatttcaa

SEQ ID NO: 115697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatatttagggatttcaat

SEQ ID NO: 115698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatttagggatttcaatgat

SEQ ID NO: 115699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agggatttcaatgatgacca

SEQ ID NO: 115700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gggatttcaatgatgaccat

SEQ ID NO: 115701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatgatgaccatattattt

SEQ ID NO: 115702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgatgaccatattatttg

SEQ ID NO: 115703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgttacctgaaattttaa

SEQ ID NO: 115704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttacctgaaattttaaaaa

SEQ ID NO: 115705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttacctgaaattttaaaaat

SEQ ID NO: 115706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctgaaattttaaaaattaa

SEQ ID NO: 115707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaattttaaaaattaaccaa

SEQ ID NO: 115708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaattaaccaaatctat

SEQ ID NO: 115709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaattaaccaaatctata

SEQ ID NO: 115710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaattaaccaaatctatac

SEQ ID NO: 115711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
accaaatctatacacttaag

SEQ ID NO: 115712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tacacttaagtagagtaaaa

SEQ ID NO: 115713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagtagagtaaaaacactgg

SEQ ID NO: 115714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtagagtaaaaacactgga

SEQ ID NO: 115715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaattgagccagccattatg

SEQ ID NO: 115716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agccagccattatgaatcta

SEQ ID NO: 115717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgaatctatacaatcctctt

SEQ ID NO: 115718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tacaatcctctttcctcact

SEQ ID NO: 115719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttcctcactacaacacctc

SEQ ID NO: 115720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcctcactacaacacctcaa

SEQ ID NO: 115721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctcactacaacacctcaat

SEQ ID NO: 115722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcactacaacacctcaatt

SEQ ID NO: 115723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actacaacacctcaatttgc

SEQ ID NO: 115724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caacacctcaatttgctttt

SEQ ID NO: 115725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatttgcttttaactttata

SEQ ID NO: 115726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttttaactttataatctt

SEQ ID NO: 115727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttttaactttataatcttt

SEQ ID NO: 115728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaactttataatcttttta

SEQ ID NO: 115729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taactttataatctttttat

SEQ ID NO: 115730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactttataatctttttata

SEQ ID NO: 115731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actttataatctttttataa

SEQ ID NO: 115732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tataatctttttataatctt

SEQ ID NO: 115733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataatctttttataatctta

SEQ ID NO: 115734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatctttttataatcttat

SEQ ID NO: 115735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttataatcttattagaaat

SEQ ID NO: 115736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttataatcttattagaaata

SEQ ID NO: 115737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tataatcttattagaaataa

SEQ ID NO: 115738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataatcttattagaaataaa

SEQ ID NO: 115739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatcttattagaaataaac

SEQ ID NO: 115740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attagaaataaacagtcaaa

SEQ ID NO: 115741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttagaaataaacagtcaaat

SEQ ID NO: 115742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaataaacagtcaaatata

SEQ ID NO: 115743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atcaattgactgcccatctt

SEQ ID NO: 115744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaattgactgcccatcttc

SEQ ID NO: 115745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actgcccatcttcactatga

SEQ ID NO: 115746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cccatcttcactatgaattt

SEQ ID NO: 115747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cactatgaatttgtccaggc

SEQ ID NO: 115748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actatgaatttgtccaggcc

SEQ ID NO: 115749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgaatttgtccaggccattt

SEQ ID NO: 115750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtccaggccatttcactaaa

SEQ ID NO: 115751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tccaggccatttcactaaaa

SEQ ID NO: 115752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cactaaaagactagcatgag

SEQ ID NO: 115753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actaaaagactagcatgagc

SEQ ID NO: 115754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaagactagcatgagccagg

SEQ ID NO: 115755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcatgagccaggataactct

SEQ ID NO: 115756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tccccagacctctagccctg

SEQ ID NO: 115757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cccagacctctagccctgat

SEQ ID NO: 115758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagccctgataactcttaga

SEQ ID NO: 115759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gccctgataactcttagatg

SEQ ID NO: 115760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ataactcttagatgtccttc

SEQ ID NO: 115761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttagatgtccttcacatctc

SEQ ID NO: 115762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agatgtccttcacatctcat

SEQ ID NO: 115763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatgtccttcacatctcatt

SEQ ID NO: 115764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacatctcattgatactaag

SEQ ID NO: 115765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acatctcattgatactaagg

SEQ ID NO: 115766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attgatactaaggagctttc

SEQ ID NO: 115767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atactaaggagctttctcta

SEQ ID NO: 115768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aggagctttctctaacaagg

SEQ ID NO: 115769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctctaacaaggtgctaggt

SEQ ID NO: 115770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctaacaaggtgctaggta

SEQ ID NO: 115771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctaacaaggtgctaggtac

SEQ ID NO: 115772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taacaaggtgctaggtacac

SEQ ID NO: 115773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acaaggtgctaggtacactc

SEQ ID NO: 115774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtacactcatctgtgtcac

SEQ ID NO: 115775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atctgtgtcacaatttaact

SEQ ID NO: 115776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtcacaatttaactattgt

SEQ ID NO: 115777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactattgtccatgaataca

SEQ ID NO: 115778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actattgtccatgaatacac

SEQ ID NO: 115779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgtccatgaatacacagct

SEQ ID NO: 115780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tccatgaatacacagcttca

SEQ ID NO: 115781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catttaactaattagtagaa

SEQ ID NO: 115782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttaactaattagtagaat

SEQ ID NO: 115783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactaattagtagaatttta

SEQ ID NO: 115784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actaattagtagaattttat

SEQ ID NO: 115785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attagtagaattttatgtac

SEQ ID NO: 115786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtagaattttatgtacctgg

SEQ ID NO: 115787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgtacctgggaactttta

SEQ ID NO: 115788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgtacctgggaacttttaa

SEQ ID NO: 115789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtacctgggaacttttaag

SEQ ID NO: 115790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaacttttaagagtatgaa

SEQ ID NO: 115791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaagagtatgaaatcctac

SEQ ID NO: 115792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagagtatgaaatcctaca

SEQ ID NO: 115793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagagtatgaaatcctacaa

SEQ ID NO: 115794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agagtatgaaatcctacaag

SEQ ID NO: 115795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caagcagtgtatctttagcc

SEQ ID NO: 115796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagcctgtaacattgcttgg

SEQ ID NO: 115797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcctgtaacattgcttgga

SEQ ID NO: 115798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcctgtaacattgcttggaa

SEQ ID NO: 115799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taacattgcttggaacaaag

SEQ ID NO: 115800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttggaacaaagcagacctg

SEQ ID NO: 115801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaacaaagcagacctgtca

SEQ ID NO: 115802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaacaaagcagacctgtcat

SEQ ID NO: 115803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcatttggttttgtagcctt

SEQ ID NO: 115804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggttttgtagcctttgtagt

SEQ ID NO: 115805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gttttgtagcctttgtagtc

SEQ ID NO: 115806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtagcctttgtagtccctg

SEQ ID NO: 115807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtagcctttgtagtccctga

SEQ ID NO: 115808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagcctttgtagtccctgac

SEQ ID NO: 115809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtagtccctgacactctgg

SEQ ID NO: 115810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtagtccctgacactctgga

SEQ ID NO: 115811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagtccctgacactctggaa

SEQ ID NO: 115812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acactctggaacattagaga

SEQ ID NO: 115813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tggaacattagagagagtga

SEQ ID NO: 115814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaacattagagagagtgaaa

SEQ ID NO: 115815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagagagtgaaaatattatt

SEQ ID NO: 115816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctagagtgaaggaattct

SEQ ID NO: 115817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagagtgaaggaattctgtg

SEQ ID NO: 115818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gagtgaaggaattctgtgtt

SEQ ID NO: 115819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtgttttcatcccagtatt

SEQ ID NO: 115820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgttttcatcccagtattgg

SEQ ID NO: 115821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatcccagtattggttaca

SEQ ID NO: 115822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catcccagtattggttacat

SEQ ID NO: 115823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcccagtattggttacatg

SEQ ID NO: 115824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gttacatggtttgtttcgtt

SEQ ID NO: 115825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catggtttgtttcgtttgtg

SEQ ID NO: 115826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttcgtttgtgaagaattc

SEQ ID NO: 115827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttcgtttgtgaagaattca

SEQ ID NO: 115828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgtttgtgaagaattcatca

SEQ ID NO: 115829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gtttgtgaagaattcatcaa

SEQ ID NO: 115830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgaagaattcatcaaacta

SEQ ID NO: 115831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaagaattcatcaaactat

SEQ ID NO: 115832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcaaactatatttttagga

SEQ ID NO: 115833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatttttaggatatatgcat

SEQ ID NO: 115834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaggatatatgcatttttt

SEQ ID NO: 115835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taggatatatgcattttttt

SEQ ID NO: 115836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggatatatgcatttttttt

SEQ ID NO: 115837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggatatatgcattttttttt

SEQ ID NO: 115838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttaacttttatttta

SEQ ID NO: 115839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttaacttttattttaa

SEQ ID NO: 115840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttaacttttattttaag

SEQ ID NO: 115841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaacttttattttaagt

SEQ ID NO: 115842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaacttttattttaagtt

SEQ ID NO: 115843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaacttttattttaagttc

SEQ ID NO: 115844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacttttattttaagttca

SEQ ID NO: 115845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacttttattttaagttcag

SEQ ID NO: 115846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acttttattttaagttcagg

SEQ ID NO: 115847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttattttaagttcaggagta

SEQ ID NO: 115848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttaagttcaggagtac

SEQ ID NO: 115849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttaagttcaggagtaca

SEQ ID NO: 115850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaagttcaggagtacaa

SEQ ID NO: 115851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagttcaggagtacaagtc

SEQ ID NO: 115852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagttcaggagtacaagtcc

SEQ ID NO: 115853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agttcaggagtacaagtcca

SEQ ID NO: 115854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggagtacaagtccaggttt

SEQ ID NO: 115855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttacataggtaaacttgtg

SEQ ID NO: 115856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttacataggtaaacttgtgt

SEQ ID NO: 115857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cataggtaaacttgtgtcat

SEQ ID NO: 115858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgtcatgggggtttgtttt

SEQ ID NO: 115859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtcatgggggtttgtttta

SEQ ID NO: 115860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttttacagcttatttcatc

SEQ ID NO: 115861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttacagcttatttcatca

SEQ ID NO: 115862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacagcttatttcatcaccc

SEQ ID NO: 115863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acagcttatttcatcaccca

SEQ ID NO: 115864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagcttatttcatcacccag

SEQ ID NO: 115865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttcatcacccaggtatta

SEQ ID NO: 115866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcatcacccaggtattag

SEQ ID NO: 115867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catcacccaggtattagacc

SEQ ID NO: 115868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcacccaggtattagacct

SEQ ID NO: 115869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gacctagtactcattggtta

SEQ ID NO: 115870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtactcattggttatttttc

SEQ ID NO: 115871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attggttatttttcctgatc

SEQ ID NO: 115872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gttatttttcctgatcttct

SEQ ID NO: 115873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttcctgatcttctgcct

SEQ ID NO: 115874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcctgatcttctgcctcct

SEQ ID NO: 115875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctgatcttctgcctcctc

SEQ ID NO: 115876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgatcttctgcctcctcc

SEQ ID NO: 115877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgatcttctgcctcctccc

SEQ ID NO: 115878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atcttctgcctcctcccacc

SEQ ID NO: 115879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgcctcctcccaccctcta

SEQ ID NO: 115880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcctcctcccaccctctac

SEQ ID NO: 115881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctcctcccaccctctactg

SEQ ID NO: 115882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcccaccctctactgtatt

SEQ ID NO: 115883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaccctctactgtatttga

SEQ ID NO: 115884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tactgtatttgaaaggttcc

SEQ ID NO: 115885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgtatttgaaaggttccag

SEQ ID NO: 115886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatttgaaaggttccagtgt

SEQ ID NO: 115887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaggttccagtgtgtgtt

SEQ ID NO: 115888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaggttccagtgtgtgttt

SEQ ID NO: 115889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagtgtgtgtttttcccctc

SEQ ID NO: 115890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcccctctatgtgtctcac

SEQ ID NO: 115891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcccctctatgtgtctcact

SEQ ID NO: 115892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccctctatgtgtctcactt

SEQ ID NO: 115893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccctctatgtgtctcactta

SEQ ID NO: 115894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatgtgtctcacttataagc

SEQ ID NO: 115895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtgtctcacttataagcga

SEQ ID NO: 115896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acttataagcgagaacatga

SEQ ID NO: 115897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataagcgagaacatgatata

SEQ ID NO: 115898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taagcgagaacatgatatat

SEQ ID NO: 115899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatttaagtatgttatact

SEQ ID NO: 115900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttaagtatgttatactt

SEQ ID NO: 115901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttaagtatgttatactta

SEQ ID NO: 115902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaagtatgttatacttaa

SEQ ID NO: 115903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagtatgttatacttaatga

SEQ ID NO: 115904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtatgttatacttaatgaa

SEQ ID NO: 115905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacttaatgaaaagttaaaa

SEQ ID NO: 115906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatgaaaagttaaaaagatg

SEQ ID NO: 115907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgaaaagttaaaaagatga

SEQ ID NO: 115908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaagatgaacgtaaaatgt

SEQ ID NO: 115909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaaacttctttttctga

SEQ ID NO: 115910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaacttctttttctgaa

SEQ ID NO: 115911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaacttctttttctgaaa

SEQ ID NO: 115912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaacttctttttctgaaaa

SEQ ID NO: 115913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttttctgaaaactcaagt

SEQ ID NO: 115914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttctgaaaactcaagtt

SEQ ID NO: 115915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttctgaaaactcaagttga

SEQ ID NO: 115916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctgaaaactcaagttgag

SEQ ID NO: 115917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgaaaactcaagttgaga

SEQ ID NO: 115918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaaaactcaagttgagag

SEQ ID NO: 115919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaaaactcaagttgagaga

SEQ ID NO: 115920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaactcaagttgagagaat

SEQ ID NO: 115921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagttgagagaattaatcat

SEQ ID NO: 115922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agagaattaatcattgtact

SEQ ID NO: 115923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcattgtactaaaatatac

SEQ ID NO: 115924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tactaaaatatacactaaag

SEQ ID NO: 115925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatatacactaaaggaagt

SEQ ID NO: 115926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaggaagtactttaggcaga

SEQ ID NO: 115927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taggcagaaggaaaagatct

SEQ ID NO: 115928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggcagaaggaaaagatctt

SEQ ID NO: 115929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggcagaaggaaaagatctta

SEQ ID NO: 115930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agacaaaaagaatggaaaca

SEQ ID NO: 115931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gacaaaaagaatggaaacac

SEQ ID NO: 115932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaataggcgcctgtttacat

SEQ ID NO: 115933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttacatgtaaggaaaaatg

SEQ ID NO: 115934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatgtaaggaaaaatggac

SEQ ID NO: 115935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catgtaaggaaaaatggact

SEQ ID NO: 115936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tacaaaggtgaaaaatgact

SEQ ID NO: 115937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaaggtgaaaaatgactac

SEQ ID NO: 115938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacaaagcaataaggtttat

SEQ ID NO: 115939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgttttatggttttcaaaa

SEQ ID NO: 115940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgttttatggttttcaaaac

SEQ ID NO: 115941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatggttttcaaaactatat

SEQ ID NO: 115942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atggttttcaaaactatata

SEQ ID NO: 115943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggttttcaaaactatatag

SEQ ID NO: 115944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaaactatataggttaaa

SEQ ID NO: 115945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaactatataggttaaaa

SEQ ID NO: 115946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaactatataggttaaaat

SEQ ID NO: 115947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tataggttaaaatgcattaa

SEQ ID NO: 115948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgcattaagtccaattt

SEQ ID NO: 115949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtccaatttttattttctt

SEQ ID NO: 115950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattttcttgaatccctta

SEQ ID NO: 115951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttcttgaatcccttac

SEQ ID NO: 115952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttcttgaatcccttacc

SEQ ID NO: 115953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcttgaatcccttacca

SEQ ID NO: 115954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttgaatcccttaccatta

SEQ ID NO: 115955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgaatcccttaccattat

SEQ ID NO: 115956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgaatcccttaccattatt

SEQ ID NO: 115957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaatcccttaccattatttg

SEQ ID NO: 115958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatcccttaccattatttgt

SEQ ID NO: 115959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
accattatttgtatatgaaa

SEQ ID NO: 115960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccattatttgtatatgaaaa

SEQ ID NO: 115961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgtatatgaaaactgatt

SEQ ID NO: 115962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatatgaaaactgattttc

SEQ ID NO: 115963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatatgaaaactgattttct

SEQ ID NO: 115964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attttctttaatcttatttt

SEQ ID NO: 115965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttaatcttattttgact

SEQ ID NO: 115966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttaatcttattttgactt

SEQ ID NO: 115967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttaatcttattttgacttt

SEQ ID NO: 115968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taatcttattttgactttca

SEQ ID NO: 115969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatcttattttgactttcaa

SEQ ID NO: 115970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcttattttgactttcaat

SEQ ID NO: 115971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attttgactttcaattattt

SEQ ID NO: 115972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttgactttcaattatttt

SEQ ID NO: 115973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgactttcaattattttagt

SEQ ID NO: 115974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gactttcaattattttagtc

SEQ ID NO: 115975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actttcaattattttagtct

SEQ ID NO: 115976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaattattttagtctacaa

SEQ ID NO: 115977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caattattttagtctacaac

SEQ ID NO: 115978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aattattttagtctacaaca

SEQ ID NO: 115979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttagtctacaacatttga

SEQ ID NO: 115980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagtctacaacatttgagtg

SEQ ID NO: 115981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtctacaacatttgagtga

SEQ ID NO: 115982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtctacaacatttgagtgat

SEQ ID NO: 115983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caacatttgagtgatttaat

SEQ ID NO: 115984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagtgatttaattggtaaag

SEQ ID NO: 115985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtgatttaattggtaaagt

SEQ ID NO: 115986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattggtaaagtaattgctc

SEQ ID NO: 115987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attggtaaagtaattgctct

SEQ ID NO: 115988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtaaagtaattgctctcagg

SEQ ID NO: 115989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctctcaggtttacataaaat

SEQ ID NO: 115990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaggtttacataaaatttt

SEQ ID NO: 115991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggtttacataaaatttttt

SEQ ID NO: 115992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acataaaattttttctctgt

SEQ ID NO: 115993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cataaaattttttctctgtt

SEQ ID NO: 115994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctctgttgtgtagaaaa

SEQ ID NO: 115995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctctgttgtgtagaaaac

SEQ ID NO: 115996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctctgttgtgtagaaaaca

SEQ ID NO: 115997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctgttgtgtagaaaacac

SEQ ID NO: 115998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgttgtgtagaaaacacc

SEQ ID NO: 115999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgttgtgtagaaaacaccat

SEQ ID NO: 116000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgtgtagaaaacaccatcc

SEQ ID NO: 116001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtagaaaacaccatccatg

SEQ ID NO: 116002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttaatgtacaatatagta

SEQ ID NO: 116003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatgtacaatatagtataaa

SEQ ID NO: 116004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgtacaatatagtataaaa

SEQ ID NO: 116005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttttacaaaagtagcct

SEQ ID NO: 116006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttacaaaagtagccttat

SEQ ID NO: 116007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttacaaaagtagccttatt

SEQ ID NO: 116008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttacaaaagtagccttattt

SEQ ID NO: 116009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacaaaagtagccttatttt

SEQ ID NO: 116010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaaaagtagccttattttg

SEQ ID NO: 116011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaaagtagccttattttga

SEQ ID NO: 116012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attttgaaagaccttttaat

SEQ ID NO: 116013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttgaaagaccttttaata

SEQ ID NO: 116014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaaagaccttttaataact

SEQ ID NO: 116015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaagaccttttaataactg

SEQ ID NO: 116016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaagaccttttaataactga

SEQ ID NO: 116017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaataactgaaaattagaa

SEQ ID NO: 116018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taataactgaaaattagaaa

SEQ ID NO: 116019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aataactgaaaattagaaag

SEQ ID NO: 116020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataactgaaaattagaaagc

SEQ ID NO: 116021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaattagaaagcgatctta

SEQ ID NO: 116022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaagcgatcttaagtgacc

SEQ ID NO: 116023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagtgaccagccatcaatta

SEQ ID NO: 116024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtgaccagccatcaattaa

SEQ ID NO: 116025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattgattatctgcatcatt

SEQ ID NO: 116026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attatctgcatcattattat

SEQ ID NO: 116027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgcatcattattatttgc

SEQ ID NO: 116028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catcattattatttgcatta

SEQ ID NO: 116029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatttgcattaatttttta

SEQ ID NO: 116030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgcattaattttttaaaa

SEQ ID NO: 116031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcattaattttttaaaatgc

SEQ ID NO: 116032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattaattttttaaaatgcc

SEQ ID NO: 116033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttttaaaatgccatcat

SEQ ID NO: 116034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaaatgccatcataata

SEQ ID NO: 116035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaatgccatcataataa

SEQ ID NO: 116036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaatgccatcataataac

SEQ ID NO: 116037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatgccatcataataact

SEQ ID NO: 116038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgccatcataataactt

SEQ ID NO: 116039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctagcacaattaacagaat

SEQ ID NO: 116040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctagcacaattaacagaatg

SEQ ID NO: 116041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcacaattaacagaatgtag

SEQ ID NO: 116042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acagaatgtagtttggaaat

SEQ ID NO: 116043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaaatttttctttattaaa

SEQ ID NO: 116044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaatttttctttattaaac

SEQ ID NO: 116045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctttattaaactacaaaa

SEQ ID NO: 116046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttattaaactacaaaag

SEQ ID NO: 116047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttattaaactacaaaaga

SEQ ID NO: 116048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttattaaactacaaaagat

SEQ ID NO: 116049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattaaactacaaaagatta

SEQ ID NO: 116050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaaactacaaaagattaa

SEQ ID NO: 116051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaactacaaaagattaaa

SEQ ID NO: 116052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aactacaaaagattaaagta

SEQ ID NO: 116053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaaagattaaagtaaaaaa

SEQ ID NO: 116054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtaaaaaaatgcctaaat

SEQ ID NO: 116055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatattatcggttccttact

SEQ ID NO: 116056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcggttccttacttttcaaa

SEQ ID NO: 116057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttacttttcaaattaccaa

SEQ ID NO: 116058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acttttcaaattaccaaaac

SEQ ID NO: 116059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttttcaaattaccaaaaca

SEQ ID NO: 116060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcaaattaccaaaacaaaa

SEQ ID NO: 116061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaattaccaaaacaaaat

SEQ ID NO: 116062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaattaccaaaacaaaatg

SEQ ID NO: 116063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaattaccaaaacaaaatga

SEQ ID NO: 116064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccaaaacaaaatgaaggtag

SEQ ID NO: 116065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gattttaaggtttacccccg

SEQ ID NO: 116066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attttaaggtttacccccgc

SEQ ID NO: 116067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaggtttacccccgcagca

SEQ ID NO: 116068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaggtttacccccgcagcaa

SEQ ID NO: 116069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggtttacccccgcagcaag

SEQ ID NO: 116070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acccccgcagcaagttatga

SEQ ID NO: 116071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccccgcagcaagttatgaa

SEQ ID NO: 116072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgaaaataatggtcacatgt

SEQ ID NO: 116073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactgatattcctttaatag

SEQ ID NO: 116074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atattcctttaataggttca

SEQ ID NO: 116075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttaataggttcatttcat

SEQ ID NO: 116076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taataggttcatttcatttt

SEQ ID NO: 116077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aataggttcatttcatttta

SEQ ID NO: 116078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataggttcatttcattttac

SEQ ID NO: 116079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttcattttacttactctt

SEQ ID NO: 116080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattttacttactcttcaac

SEQ ID NO: 116081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attttacttactcttcaaca

SEQ ID NO: 116082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacttactcttcaacagata

SEQ ID NO: 116083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttactcttcaacagatat

SEQ ID NO: 116084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttactcttcaacagatatt

SEQ ID NO: 116085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actcttcaacagatatttta

SEQ ID NO: 116086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcttcaacagatattttaa

SEQ ID NO: 116087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcaacagatattttaaaat

SEQ ID NO: 116088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caacagatattttaaaatac

SEQ ID NO: 116089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacagatattttaaaataca

SEQ ID NO: 116090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaatacactttattgtgt

SEQ ID NO: 116091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatacactttattgtgta

SEQ ID NO: 116092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatacactttattgtgtat

SEQ ID NO: 116093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattgtgtatatttaaggta

SEQ ID NO: 116094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgtgtatatttaaggtat

SEQ ID NO: 116095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgtgtatatttaaggtata

SEQ ID NO: 116096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtatatttaaggtatacaa

SEQ ID NO: 116097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaggtatacaacatgatgct

SEQ ID NO: 116098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggtatacaacatgatgcta

SEQ ID NO: 116099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttggatacatgtagatagta

SEQ ID NO: 116100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gatacatgtagatagtaaaa

SEQ ID NO: 116101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccatagtaaaggaaattaac

SEQ ID NO: 116102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatatctaccatctctagt

SEQ ID NO: 116103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccatctctagttgttaccca

SEQ ID NO: 116104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagttgttacccatttttgt

SEQ ID NO: 116105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gttgttacccatttttgttg

SEQ ID NO: 116106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttacccatttttgttgtttg

SEQ ID NO: 116107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccatttttgttgtttgtta

SEQ ID NO: 116108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgttgtttgttattgttgg

SEQ ID NO: 116109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttgtttgttattgttggg

SEQ ID NO: 116110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttgtttgttattgttgggg

SEQ ID NO: 116111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgtttgttattgttggggg

SEQ ID NO: 116112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgttattgttgggggggg

SEQ ID NO: 116113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttattgttgggggggggtt

SEQ ID NO: 116114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttattgttgggggggggttg

SEQ ID NO: 116115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgttgggggggggttgttg

SEQ ID NO: 116116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgggggggggttgttgttg

SEQ ID NO: 116117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggggggggttgttgttgttg

SEQ ID NO: 116118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgttgttgtttggaggtaa

SEQ ID NO: 116119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgttgtttggaggtaagag

SEQ ID NO: 116120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgtttggaggtaagagcaa

SEQ ID NO: 116121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttggaggtaagagcaacaa

SEQ ID NO: 116122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaggtaagagcaacaaata

SEQ ID NO: 116123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaggtaagagcaacaaatat

SEQ ID NO: 116124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaggtgccaggtgcctgg

SEQ ID NO: 116125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaggtgccaggtgcctggg

SEQ ID NO: 116126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaggtgccaggtgcctggga

SEQ ID NO: 116127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggtgccaggtgcctgggac

SEQ ID NO: 116128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggacacaatactaactaggt

SEQ ID NO: 116129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actaggtggccttgatcctt

SEQ ID NO: 116130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtggccttgatccttgtcc

SEQ ID NO: 116131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatccttgtcctctagggct

SEQ ID NO: 116132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atccttgtcctctagggctt

SEQ ID NO: 116133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtcctctagggcttacagtc

SEQ ID NO: 116134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcctctagggcttacagtct

SEQ ID NO: 116135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagggcttacagtctgttgg

SEQ ID NO: 116136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gggcttacagtctgttgggg

SEQ ID NO: 116137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acagtctgttggggaaaacc

SEQ ID NO: 116138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagtctgttggggaaaacca

SEQ ID NO: 116139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttggggaaaaccagcaggta

SEQ ID NO: 116140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggaaaaccagcaggtaaac

SEQ ID NO: 116141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caacacacctactatatgag

SEQ ID NO: 116142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctatatgagagcaatgagaa

SEQ ID NO: 116143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatgagagcaatgagaacac

SEQ ID NO: 116144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acttggacttaggaagaaag

SEQ ID NO: 116145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggacttaggaagaaagattt

SEQ ID NO: 116146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gacttaggaagaaagatttt

SEQ ID NO: 116147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aggaagaaagattttggtca

SEQ ID NO: 116148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaagaaagattttggtcag

SEQ ID NO: 116149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggtcagggaaggaagatga

SEQ ID NO: 116150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtcagggaaggaagatgag

SEQ ID NO: 116151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtcagggaaggaagatgagt

SEQ ID NO: 116152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctggtctgtactatgacag

SEQ ID NO: 116153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctggtctgtactatgacagg

SEQ ID NO: 116154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtctgtactatgacaggtat

SEQ ID NO: 116155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tactatgacaggtatctcct

SEQ ID NO: 116156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgacaggtatctcctacaat

SEQ ID NO: 116157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctacaattcctccctcttgt

SEQ ID NO: 116158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caattcctccctcttgtgtt

SEQ ID NO: 116159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctccctcttgtgttaacagt

SEQ ID NO: 116160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctcttgtgttaacagtttg

SEQ ID NO: 116161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgtgttaacagtttgctat

SEQ ID NO: 116162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgttaacagtttgctatga

SEQ ID NO: 116163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgttaacagtttgctatgat

SEQ ID NO: 116164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acagtttgctatgatccagg

SEQ ID NO: 116165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctatgatccaggagctgtc

SEQ ID NO: 116166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctatgatccaggagctgtct

SEQ ID NO: 116167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgatccaggagctgtctcct

SEQ ID NO: 116168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctccttcatttttggcttt

SEQ ID NO: 116169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttcatttttggctttgtca

SEQ ID NO: 116170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catttttggctttgtcatca

SEQ ID NO: 116171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttttggctttgtcatcaa

SEQ ID NO: 116172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttggctttgtcatcaagtct

SEQ ID NO: 116173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggctttgtcatcaagtctg

SEQ ID NO: 116174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggctttgtcatcaagtctga

SEQ ID NO: 116175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctttgtcatcaagtctgat

SEQ ID NO: 116176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtcatcaagtctgattgtc

SEQ ID NO: 116177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcatcaagtctgattgtcc

SEQ ID NO: 116178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcatcaagtctgattgtcct

SEQ ID NO: 116179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attgtccttacttactctca

SEQ ID NO: 116180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tccttacttactctcaactt

SEQ ID NO: 116181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acttactctcaacttttcca

SEQ ID NO: 116182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttactctcaacttttccaa

SEQ ID NO: 116183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actctcaacttttccaaaca

SEQ ID NO: 116184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctctcaacttttccaaacaa

SEQ ID NO: 116185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaacttttccaaacaagaa

SEQ ID NO: 116186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aacttttccaaacaagaaaa

SEQ ID NO: 116187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttccaaacaagaaaaaaaat

SEQ ID NO: 116188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccaaacaagaaaaaaaatc

SEQ ID NO: 116189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaaacaagaaaaaaaatca

SEQ ID NO: 116190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaacaagaaaaaaaatcat

SEQ ID NO: 116191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggctttgtccttcgatgga

SEQ ID NO: 116192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggctttgtccttcgatggaa

SEQ ID NO: 116193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctttgtccttcgatggaat

SEQ ID NO: 116194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtccttcgatggaatttga

SEQ ID NO: 116195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtccttcgatggaatttgaa

SEQ ID NO: 116196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tccttcgatggaatttgaaa

SEQ ID NO: 116197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cgatggaatttgaaatatat

SEQ ID NO: 116198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gatggaatttgaaatatata

SEQ ID NO: 116199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaatatatagcttcataaa

SEQ ID NO: 116200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatatatagcttcataaac

SEQ ID NO: 116201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cataaactctctagattttc

SEQ ID NO: 116202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataaactctctagattttct

SEQ ID NO: 116203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctagattttctattcctgt

SEQ ID NO: 116204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagattttctattcctgtac

SEQ ID NO: 116205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gattttctattcctgtactt

SEQ ID NO: 116206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctattcctgtacttgtcta

SEQ ID NO: 116207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctattcctgtacttgtctag

SEQ ID NO: 116208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattcctgtacttgtctagt

SEQ ID NO: 116209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttcctgtacttgtctagtct

SEQ ID NO: 116210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgtacttgtctagtcttca

SEQ ID NO: 116211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tacttgtctagtcttcaaac

SEQ ID NO: 116212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtctagtcttcaaactattc

SEQ ID NO: 116213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctagtcttcaaactattct

SEQ ID NO: 116214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtcttcaaactattctaatt

SEQ ID NO: 116215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaactattctaattaaaaa

SEQ ID NO: 116216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaactattctaattaaaaat

SEQ ID NO: 116217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttctaattaaaaattttaaa

SEQ ID NO: 116218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taattaaaaattttaaagga

SEQ ID NO: 116219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attaaaaattttaaaggatg

SEQ ID NO: 116220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaattttaaaggatgcaca

SEQ ID NO: 116221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaggatgcacaaagctta

SEQ ID NO: 116222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaggatgcacaaagcttat

SEQ ID NO: 116223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaggatgcacaaagcttatt

SEQ ID NO: 116224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attttccttctaaaggttaa

SEQ ID NO: 116225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttccttctaaaggttaaa

SEQ ID NO: 116226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccttctaaaggttaaatca

SEQ ID NO: 116227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttctaaaggttaaatcat

SEQ ID NO: 116228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttctaaaggttaaatcata

SEQ ID NO: 116229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaaaggttaaatcataact

SEQ ID NO: 116230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaaggttaaatcataactt

SEQ ID NO: 116231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaggttaaatcataacttac

SEQ ID NO: 116232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatcataacttacttgtatt

SEQ ID NO: 116233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acttgtattgtggataatat

SEQ ID NO: 116234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttgtattgtggataatatc

SEQ ID NO: 116235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtattgtggataatatcaac

SEQ ID NO: 116236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattgtggataatatcaacc

SEQ ID NO: 116237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggataatatcaaccaaagt

SEQ ID NO: 116238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgcattctacagatttttt

SEQ ID NO: 116239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cattctacagatttttttaa

SEQ ID NO: 116240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacagatttttttaacctca

SEQ ID NO: 116241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagatttttttaacctcaag

SEQ ID NO: 116242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaacctcaagttccagg

SEQ ID NO: 116243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaacctcaagttccaggt

SEQ ID NO: 116244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaacctcaagttccaggtt

SEQ ID NO: 116245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacctcaagttccaggtta

SEQ ID NO: 116246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacctcaagttccaggttaa

SEQ ID NO: 116247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acctcaagttccaggttaaa

SEQ ID NO: 116248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagttccaggttaaattccc

SEQ ID NO: 116249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caggttaaattcccagtttg

SEQ ID NO: 116250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattcccagtttgtggccaa

SEQ ID NO: 116251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccagtttgtggccaattgtt

SEQ ID NO: 116252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtggccaattgttatcattg

SEQ ID NO: 116253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggccaattgttatcattgg

SEQ ID NO: 116254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttatcattggccatgcaaag

SEQ ID NO: 116255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcattggccatgcaaagcct

SEQ ID NO: 116256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gccatgcaaagcctcctttt

SEQ ID NO: 116257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttttattaatattttttct

SEQ ID NO: 116258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttattaatattttttctcca

SEQ ID NO: 116259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattaatattttttctccat

SEQ ID NO: 116260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaatattttttctccatt

SEQ ID NO: 116261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaatattttttctccattg

SEQ ID NO: 116262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atattttttctccattgccc

SEQ ID NO: 116263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctccattgcccccatat

SEQ ID NO: 116264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctccattgcccccatatc

SEQ ID NO: 116265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctccattgcccccatatcc

SEQ ID NO: 116266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctccattgcccccatatccc

SEQ ID NO: 116267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccattgcccccatatccca

SEQ ID NO: 116268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cattgcccccatatcccatt

SEQ ID NO: 116269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccccatatcccattctctg

SEQ ID NO: 116270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgccactctacctgtttt

SEQ ID NO: 116271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgccactctacctgtttttc

SEQ ID NO: 116272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccactctacctgtttttcat

SEQ ID NO: 116273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tacctgtttttcattcccat

SEQ ID NO: 116274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctgtttttcattcccatgc

SEQ ID NO: 116275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttttcattcccatgcttag

SEQ ID NO: 116276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcattcccatgcttagcaa

SEQ ID NO: 116277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattcccatgcttagcaac

SEQ ID NO: 116278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattcccatgcttagcaacc

SEQ ID NO: 116279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attcccatgcttagcaacca

SEQ ID NO: 116280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccatgcttagcaaccattat

SEQ ID NO: 116281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agcaaccattataatgtgtt

SEQ ID NO: 116282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaaccattataatgtgttt

SEQ ID NO: 116283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatgtgtttatgaacatct

SEQ ID NO: 116284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgaacatctttctgttttc

SEQ ID NO: 116285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgaacatctttctgttttct

SEQ ID NO: 116286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctgttttcttgaaaattga

SEQ ID NO: 116287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgttttcttgaaaattgaa

SEQ ID NO: 116288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttttcttgaaaattgaat

SEQ ID NO: 116289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttcttgaaaattgaatat

SEQ ID NO: 116290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttgaaaattgaatattgt

SEQ ID NO: 116291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgaaaattgaatattgta

SEQ ID NO: 116292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgaaaattgaatattgtac

SEQ ID NO: 116293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaaattgaatattgtacac

SEQ ID NO: 116294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaattgaatattgtacaca

SEQ ID NO: 116295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatattgtacacatgaatct

SEQ ID NO: 116296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tacacatgaatctctaattt

SEQ ID NO: 116297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taatttacatacattttctc

SEQ ID NO: 116298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttacatacattttctcat

SEQ ID NO: 116299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatacattttctcattgtt

SEQ ID NO: 116300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catacattttctcattgttt

SEQ ID NO: 116301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctcattgtttgtttttatt

SEQ ID NO: 116302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcattgtttgtttttattt

SEQ ID NO: 116303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcattgtttgtttttattta

SEQ ID NO: 116304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attgtttgtttttatttact

SEQ ID NO: 116305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgtttttatttactaagc

SEQ ID NO: 116306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttttatttactaagcact

SEQ ID NO: 116307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttttatttactaagcacta

SEQ ID NO: 116308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatttactaagcactatga

SEQ ID NO: 116309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttactaagcactatgat

SEQ ID NO: 116310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttactaagcactatgatt

SEQ ID NO: 116311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttactaagcactatgattt

SEQ ID NO: 116312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actaagcactatgatttaaa

SEQ ID NO: 116313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaagcactatgatttaaag

SEQ ID NO: 116314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agcactatgatttaaagtac

SEQ ID NO: 116315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgatttaaagtacttagcat

SEQ ID NO: 116316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagtacttagcattcatgt

SEQ ID NO: 116317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtacttagcattcatgtt

SEQ ID NO: 116318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agcattcatgttgttgtaaa

SEQ ID NO: 116319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcattcatgttgttgtaaat

SEQ ID NO: 116320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgttgttgtaaatacatct

SEQ ID NO: 116321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgtaaatacatctaatctg

SEQ ID NO: 116322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaatacatctaatctgcac

SEQ ID NO: 116323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atctgcacttctaactactg

SEQ ID NO: 116324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cacttctaactactgcataa

SEQ ID NO: 116325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaactactgcataatattc

SEQ ID NO: 116326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taactactgcataatattcc

SEQ ID NO: 116327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actactgcataatattccag

SEQ ID NO: 116328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgcataatattccagtgta

SEQ ID NO: 116329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cataatattccagtgtatat

SEQ ID NO: 116330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagtgtatattaccagacat

SEQ ID NO: 116331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccagacattttacctatttg

SEQ ID NO: 116332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacctatttgctctcttagt

SEQ ID NO: 116333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acctatttgctctcttagtg

SEQ ID NO: 116334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctatttgctctcttagtga

SEQ ID NO: 116335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttgctctcttagtgataac

SEQ ID NO: 116336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctctcttagtgataacacc

SEQ ID NO: 116337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctctcttagtgataacacct

SEQ ID NO: 116338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcttagtgataacacctggc

SEQ ID NO: 116339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttagtgataacacctggcaa

SEQ ID NO: 116340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtgataacacctggcaatc

SEQ ID NO: 116341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgataacacctggcaatcc

SEQ ID NO: 116342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcaatccagcagtccccaac

SEQ ID NO: 116343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttggaaccaaggactggtt

SEQ ID NO: 116344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttggaaccaaggactggttt

SEQ ID NO: 116345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaaccaaggactggtttca

SEQ ID NO: 116346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaccaaggactggtttcat

SEQ ID NO: 116347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtttcatggaagacaatttt

SEQ ID NO: 116348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catggaagacaattttttca

SEQ ID NO: 116349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atggaagacaattttttcag

SEQ ID NO: 116350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcagggcagcagggaagg

SEQ ID NO: 116351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcagggcagcagggaagga

SEQ ID NO: 116352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagggcagcagggaaggag

SEQ ID NO: 116353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagggcagcagggaaggagg

SEQ ID NO: 116354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agggcagcagggaaggaggt

SEQ ID NO: 116355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgggacgaaactattccact

SEQ ID NO: 116356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggacgaaactattccactt

SEQ ID NO: 116357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggacgaaactattccacttc

SEQ ID NO: 116358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttccacttcagatgatcagg

SEQ ID NO: 116359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacttcagatgatcaggcat

SEQ ID NO: 116360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagatgatcaggcattagtt

SEQ ID NO: 116361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agatgatcaggcattagtta

SEQ ID NO: 116362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttagagtctcataaggagt

SEQ ID NO: 116363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagtctcataaggagtgtgc

SEQ ID NO: 116364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataaggagtgtgcaacttag

SEQ ID NO: 116365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agatccctcgtatgtgcagt

SEQ ID NO: 116366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatccctcgtatgtgcagtt

SEQ ID NO: 116367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gtatgtgcagttcacaataa

SEQ ID NO: 116368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaataaagcttgcacttct

SEQ ID NO: 116369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcacttctctgagagtctaa

SEQ ID NO: 116370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cacttctctgagagtctaat

SEQ ID NO: 116371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctctgagagtctaatgccaa

SEQ ID NO: 116372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgagagtctaatgccaag

SEQ ID NO: 116373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgagagtctaatgccaaggc

SEQ ID NO: 116374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agagtctaatgccaaggctg

SEQ ID NO: 116375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgccaaggctgatctaaca

SEQ ID NO: 116376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atctaacaggaggaagaact

SEQ ID NO: 116377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acaggaggaagaactcaggt

SEQ ID NO: 116378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggtggtaatgttcactggg

SEQ ID NO: 116379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actgggctgctgctcacctc

SEQ ID NO: 116380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggctgctgctcacctcctgc

SEQ ID NO: 116381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctgctcacctcctgctgtgc

SEQ ID NO: 116382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctcacctcctgctgtgcagc

SEQ ID NO: 116383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acctcctgctgtgcagcctg

SEQ ID NO: 116384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgctgtgcagcctggttcc

SEQ ID NO: 116385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctgtgcagcctggttcctaa

SEQ ID NO: 116386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgcagcctggttcctaacag

SEQ ID NO: 116387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttcctaacaggccatggac

SEQ ID NO: 116388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctaacaggccatggaccagt

SEQ ID NO: 116389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acaggccatggaccagtatc

SEQ ID NO: 116390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcactggcccaggggatgga

SEQ ID NO: 116391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcccaggggatggaaacccc

SEQ ID NO: 116392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atctaacccactgtggccta

SEQ ID NO: 116393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acccactgtggcctataaac

SEQ ID NO: 116394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggcctataaacagatccag

SEQ ID NO: 116395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaacagatccaggttttat

SEQ ID NO: 116396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatggatctgtggcttatac

SEQ ID NO: 116397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atggatctgtggcttataca

SEQ ID NO: 116398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggatctgtggcttatacaa

SEQ ID NO: 116399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggcttatacaactggggga

SEQ ID NO: 116400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atacaactgggggaggaggt

SEQ ID NO: 116401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacaactgggggaggaggtt

SEQ ID NO: 116402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggggaggaggttgagaaaaa

SEQ ID NO: 116403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaaaaaatgcaaaaataca

SEQ ID NO: 116404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggcacaaaagacagattaat

SEQ ID NO: 116405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atataaaagtgaatgtttat

SEQ ID NO: 116406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaaaagtgagaacaaaaa

SEQ ID NO: 116407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaaagtgagaacaaaaat

SEQ ID NO: 116408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagtgagaacaaaaattaa

SEQ ID NO: 116409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataagttgtctctgtatta

SEQ ID NO: 116410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctctgtattaaaaataatt

SEQ ID NO: 116411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtattaaaaataattaacc

SEQ ID NO: 116412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tattaaaaataattaaccaa

SEQ ID NO: 116413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaataattaaccaatacca

SEQ ID NO: 116414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
accaataccataaattccaa

SEQ ID NO: 116415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaaattttattaatttact

SEQ ID NO: 116416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattaatttactccttaaca

SEQ ID NO: 116417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaatttactccttaacac

SEQ ID NO: 116418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaatttactccttaacaca

SEQ ID NO: 116419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttactccttaacacattt

SEQ ID NO: 116420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actccttaacacatttcttt

SEQ ID NO: 116421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctccttaacacatttcttta

SEQ ID NO: 116422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttaacacatttctttagga

SEQ ID NO: 116423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacacatttctttaggactt

SEQ ID NO: 116424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acacatttctttaggacttc

SEQ ID NO: 116425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttaggacttcccttcatt

SEQ ID NO: 116426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttaggacttcccttcattt

SEQ ID NO: 116427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taggacttcccttcattttt

SEQ ID NO: 116428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggacttcccttcatttttg

SEQ ID NO: 116429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggacttcccttcatttttgg

SEQ ID NO: 116430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccttcatttttggcttcat

SEQ ID NO: 116431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttcatttttggcttcatt

SEQ ID NO: 116432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catttttggcttcattctct

SEQ ID NO: 116433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttttggcttcattctctt

SEQ ID NO: 116434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttggcttcattctctttgat

SEQ ID NO: 116435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggcttcattctctttgatc

SEQ ID NO: 116436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcttcattctctttgatct

SEQ ID NO: 116437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcttcattctctttgatctt

SEQ ID NO: 116438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattctctttgatcttccct

SEQ ID NO: 116439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attctctttgatcttccctt

SEQ ID NO: 116440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctttgatcttccctttact

SEQ ID NO: 116441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttgatcttccctttacttt

SEQ ID NO: 116442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgatcttccctttactttgt

SEQ ID NO: 116443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatcttccctttactttgta

SEQ ID NO: 116444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcttccctttactttgtat

SEQ ID NO: 116445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctttactttgtatcaatt

SEQ ID NO: 116446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctttactttgtatcaattt

SEQ ID NO: 116447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tactttgtatcaattttgta

SEQ ID NO: 116448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actttgtatcaattttgtaa

SEQ ID NO: 116449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttgtatcaattttgtaat

SEQ ID NO: 116450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtatcaattttgtaatgga

SEQ ID NO: 116451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatcaattttgtaatggag

SEQ ID NO: 116452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatcaattttgtaatggaga

SEQ ID NO: 116453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaatggagaagatagaaa

SEQ ID NO: 116454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaatggagaagatagaaaa

SEQ ID NO: 116455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatggagaagatagaaaaa

SEQ ID NO: 116456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtctttcttttaccacaac

SEQ ID NO: 116457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtctttcttttaccacaact

SEQ ID NO: 116458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttttaccacaactgagta

SEQ ID NO: 116459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttaccacaactgagtat

SEQ ID NO: 116460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttaccacaactgagtata

SEQ ID NO: 116461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaccacaactgagtatagt

SEQ ID NO: 116462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taccacaactgagtatagtg

SEQ ID NO: 116463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
accacaactgagtatagtgt

SEQ ID NO: 116464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccacaactgagtatagtgtg

SEQ ID NO: 116465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtatagtgtgtgtatgttc

SEQ ID NO: 116466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attactgatagttgagcaaa

SEQ ID NO: 116467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgatagttgagcaaatttc

SEQ ID NO: 116468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atagttgagcaaatttctct

SEQ ID NO: 116469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agcaaatttctctgagtttt

SEQ ID NO: 116470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctgagttttacaacttgt

SEQ ID NO: 116471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgagttttacaacttgtt

SEQ ID NO: 116472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgagttttacaacttgtttt

SEQ ID NO: 116473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agttttacaacttgtttttg

SEQ ID NO: 116474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacaacttgtttttggtaat

SEQ ID NO: 116475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaacttgtttttggtaatg

SEQ ID NO: 116476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caacttgtttttggtaatgg

SEQ ID NO: 116477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtttttggtaatggcatgaa

SEQ ID NO: 116478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttttggtaatggcatgaaa

SEQ ID NO: 116479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttggtaatggcatgaaaatt

SEQ ID NO: 116480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggtaatggcatgaaaattt

SEQ ID NO: 116481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtaatggcatgaaaatttt

SEQ ID NO: 116482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtaatggcatgaaaattttc

SEQ ID NO: 116483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagtattactgtcaaattt

SEQ ID NO: 116484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagtattactgtcaaatttg

SEQ ID NO: 116485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtattactgtcaaatttgg

SEQ ID NO: 116486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgtcaaatttgggaacacc

SEQ ID NO: 116487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcaaatttgggaacacctcc

SEQ ID NO: 116488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggaacacctccatcaagtt

SEQ ID NO: 116489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaacacctccatcaagttt

SEQ ID NO: 116490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catcaagtttctttcacata

SEQ ID NO: 116491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcacatatgagttgtaa

SEQ ID NO: 116492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcacatatgagttgtaag

SEQ ID NO: 116493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcacatatgagttgtaagat

SEQ ID NO: 116494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacatatgagttgtaagata

SEQ ID NO: 116495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acatatgagttgtaagatat

SEQ ID NO: 116496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagatatcagagcctgtac

SEQ ID NO: 116497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tacagtgtccttattcagaa

SEQ ID NO: 116498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attcagaagctaatcttata

SEQ ID NO: 116499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcagaagctaatcttatat

SEQ ID NO: 116500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaagctaatcttatatact

SEQ ID NO: 116501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atcttatatactctaaatcg

SEQ ID NO: 116502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atatactctaaatcgacaac

SEQ ID NO: 116503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatactctaaatcgacaaca

SEQ ID NO: 116504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taaatcgacaacacccaacc

SEQ ID NO: 116505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatcgacaacacccaaccac

SEQ ID NO: 116506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgttatcaatatcctcaatg

SEQ ID NO: 116507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttatcaatatcctcaatgta

SEQ ID NO: 116508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaatatcctcaatgtagtg

SEQ ID NO: 116509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatgtagtgatgtatgaaga

SEQ ID NO: 116510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttatctcaacatgtttggc

SEQ ID NO: 116511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttatctcaacatgtttggcc

SEQ ID NO: 116512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctcaacatgtttggccatt

SEQ ID NO: 116513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aacatgtttggccattttat

SEQ ID NO: 116514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggccattttatggcaaatga

SEQ ID NO: 116515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gccattttatggcaaatgag

SEQ ID NO: 116516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatggcaaatgagcaagaca

SEQ ID NO: 116517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atggcaaatgagcaagacat

SEQ ID NO: 116518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggcaaatgagcaagacatc

SEQ ID NO: 116519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atatttttcctcaacatatt

SEQ ID NO: 116520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcctcaacatattcatatg

SEQ ID NO: 116521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctcaacatattcatatga

SEQ ID NO: 116522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctcaacatattcatatgat

SEQ ID NO: 116523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcaacatattcatatgatt

SEQ ID NO: 116524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aacatattcatatgattcac

SEQ ID NO: 116525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatgattcactcttcttta

SEQ ID NO: 116526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actcttctttataaactgga

SEQ ID NO: 116527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttctttataaactggattat

SEQ ID NO: 116528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttataaactggattatta

SEQ ID NO: 116529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttataaactggattattac

SEQ ID NO: 116530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tataaactggattattacac

SEQ ID NO: 116531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataaactggattattacaca

SEQ ID NO: 116532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaactggattattacacaa

SEQ ID NO: 116533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gattattacacaatccaaga

SEQ ID NO: 116534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttacacaatccaagaattta

SEQ ID NO: 116535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacaatccaagaatttattt

SEQ ID NO: 116536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttaatagtgctataagag

SEQ ID NO: 116537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaatagtgctataagaga

SEQ ID NO: 116538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatagtgctataagagatga

SEQ ID NO: 116539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atagtgctataagagatgag

SEQ ID NO: 116540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taagagatgagtgtcttctt

SEQ ID NO: 116541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttctttgagaaataatact

SEQ ID NO: 116542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctttgagaaataatactt

SEQ ID NO: 116543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttgagaaataatactttt

SEQ ID NO: 116544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttgagaaataatacttttt

SEQ ID NO: 116545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgagaaataatactttttac

SEQ ID NO: 116546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagaaataatactttttact

SEQ ID NO: 116547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaaataatactttttactt

SEQ ID NO: 116548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttacttttgcttctggtat

SEQ ID NO: 116549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttacttttgcttctggtatg

SEQ ID NO: 116550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacttttgcttctggtatga

SEQ ID NO: 116551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttttgcttctggtatgac

SEQ ID NO: 116552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttttgcttctggtatgaca

SEQ ID NO: 116553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgcttctggtatgacaaaa

SEQ ID NO: 116554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcttctggtatgacaaaac

SEQ ID NO: 116555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttctggtatgacaaaact

SEQ ID NO: 116556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttctggtatgacaaaactt

SEQ ID NO: 116557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctggtatgacaaaactttgt

SEQ ID NO: 116558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggtatgacaaaactttgtt

SEQ ID NO: 116559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtatgacaaaactttgttat

SEQ ID NO: 116560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgttatagttcattgctcaa

SEQ ID NO: 116561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttatagttcattgctcaat

SEQ ID NO: 116562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttatagttcattgctcaatg

SEQ ID NO: 116563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagttcattgctcaatgtta

SEQ ID NO: 116564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attgctcaatgttaatataa

SEQ ID NO: 116565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcaatgttaatataatttc

SEQ ID NO: 116566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatgttaatataatttctgt

SEQ ID NO: 116567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atataatttctgtttatttt

SEQ ID NO: 116568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtttattttattgctcat

SEQ ID NO: 116569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtttattttattgctcatc

SEQ ID NO: 116570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttattttattgctcatcct

SEQ ID NO: 116571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttattgctcatccttgt

SEQ ID NO: 116572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttattgctcatccttgta

SEQ ID NO: 116573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattgctcatccttgtaact

SEQ ID NO: 116574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgctcatccttgtaactt

SEQ ID NO: 116575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgctcatccttgtaacttt

SEQ ID NO: 116576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcatccttgtaacttttgt

SEQ ID NO: 116577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atccttgtaacttttgtttc

SEQ ID NO: 116578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaacttttgtttcatattc

SEQ ID NO: 116579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taacttttgtttcatattcc

SEQ ID NO: 116580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgtttcatattccactaac

SEQ ID NO: 116581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtttcatattccactaact

SEQ ID NO: 116582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttcatattccactaactt

SEQ ID NO: 116583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttcatattccactaacttt

SEQ ID NO: 116584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catattccactaactttcca

SEQ ID NO: 116585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atattccactaactttccat

SEQ ID NO: 116586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cactaactttccatcactac

SEQ ID NO: 116587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actttccatcactactttaa

SEQ ID NO: 116588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccatcactactttaatata

SEQ ID NO: 116589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccatcactactttaatataa

SEQ ID NO: 116590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catcactactttaatataaa

SEQ ID NO: 116591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctttaatataaaaagtcaaa

SEQ ID NO: 116592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taatataaaaagtcaaaaat

SEQ ID NO: 116593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatataaaaagtcaaaaatg

SEQ ID NO: 116594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atataaaaagtcaaaaatga

SEQ ID NO: 116595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attatatgtctacttttttt

SEQ ID NO: 116596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatgtctacttttttttcta

SEQ ID NO: 116597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttttttttctatccaatat

SEQ ID NO: 116598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttttctatccaatatcca

SEQ ID NO: 116599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttctatccaatatccaa

SEQ ID NO: 116600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttctatccaatatccaat

SEQ ID NO: 116601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctatccaatatccaatc

SEQ ID NO: 116602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctatccaatatccaatct

SEQ ID NO: 116603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctatccaatatccaatctt

SEQ ID NO: 116604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatccaatatccaatcttc

SEQ ID NO: 116605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatccaatatccaatcttcc

SEQ ID NO: 116606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tccaatatccaatcttcctt

SEQ ID NO: 116607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttcttatctagaatgaac

SEQ ID NO: 116608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttcttatctagaatgaaca

SEQ ID NO: 116609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttatctagaatgaacaggt

SEQ ID NO: 116610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatctagaatgaacaggta

SEQ ID NO: 116611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atctagaatgaacaggtatt

SEQ ID NO: 116612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctagaatgaacaggtattt

SEQ ID NO: 116613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaatgaacaggtatttccca

SEQ ID NO: 116614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccattgtgtgtagtggtga

SEQ ID NO: 116615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccattgtgtgtagtggtgat

SEQ ID NO: 116616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtgtagtggtgatggaatt

SEQ ID NO: 116617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agagccttgacacctgccgt

SEQ ID NO: 116618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacacctgccgtggaaagct

SEQ ID NO: 116619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acacctgccgtggaaagcta

SEQ ID NO: 116620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccgtggaaagctaaagtgac

SEQ ID NO: 116621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtgactaaagtgactata

SEQ ID NO: 116622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtgactatatttccattc

SEQ ID NO: 116623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatttccattccactcctgt

SEQ ID NO: 116624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccattccactcctgttattt

SEQ ID NO: 116625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattccactcctgttatttt

SEQ ID NO: 116626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cactcctgttattttaagtg

SEQ ID NO: 116627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgttattttaagtggtgag

SEQ ID NO: 116628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttattttaagtggtgaggcc

SEQ ID NO: 116629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaagtggtgaggccatc

SEQ ID NO: 116630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagtggtgaggccatcatc

SEQ ID NO: 116631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagtggtgaggccatcatct

SEQ ID NO: 116632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtggtgaggccatcatctc

SEQ ID NO: 116633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctaagcttattcaaatggat

SEQ ID NO: 116634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agcttattcaaatggattct

SEQ ID NO: 116635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attcaaatggattctgttgc

SEQ ID NO: 116636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcaaatggattctgttgcc

SEQ ID NO: 116637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaatggattctgttgccctt

SEQ ID NO: 116638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttgccctttactttgaac

SEQ ID NO: 116639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgccctttactttgaactt

SEQ ID NO: 116640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccctttactttgaacttggt

SEQ ID NO: 116641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tactttgaacttggtgaatg

SEQ ID NO: 116642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actttgaacttggtgaatga

SEQ ID NO: 116643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttgaacttggtgaatgaa

SEQ ID NO: 116644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaacttggtgaatgaagcc

SEQ ID NO: 116645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaacttggtgaatgaagcca

SEQ ID NO: 116646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacttggtgaatgaagccaa

SEQ ID NO: 116647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtgaatgaagccaaataaa

SEQ ID NO: 116648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgaatgaagccaaataaag

SEQ ID NO: 116649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattgaaattcccttgtgct

SEQ ID NO: 116650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgaaattcccttgtgctg

SEQ ID NO: 116651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgaaattcccttgtgctgg

SEQ ID NO: 116652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaattcccttgtgctgggtc

SEQ ID NO: 116653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttgtgctgggtctatgta

SEQ ID NO: 116654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgctgggtctatgtacagc

SEQ ID NO: 116655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgctgggtctatgtacagct

SEQ ID NO: 116656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtctatgtacagctatagt

SEQ ID NO: 116657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtacagctatagtagaatc

SEQ ID NO: 116658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagtagaatcctgtgtggca

SEQ ID NO: 116659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtggcagcagtgaccagta

SEQ ID NO: 116660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gccagctgggtctgccaaac

SEQ ID NO: 116661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtctgccaaacagcctcta

SEQ ID NO: 116662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccaaacagcctctagatttc

SEQ ID NO: 116663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagatttcccttttgtcagc

SEQ ID NO: 116664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatttcccttttgtcagctc

SEQ ID NO: 116665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccttttgtcagctcatttt

SEQ ID NO: 116666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttttgtcagctcattttc

SEQ ID NO: 116667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgtcagctcattttcctat

SEQ ID NO: 116668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtcagctcattttcctata

SEQ ID NO: 116669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcagctcattttcctatac

SEQ ID NO: 116670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcagctcattttcctataca

SEQ ID NO: 116671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attttcctatacagctgctc

SEQ ID NO: 116672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctatacagctgctctagt

SEQ ID NO: 116673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctatacagctgctctagtt

SEQ ID NO: 116674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctatacagctgctctagttt

SEQ ID NO: 116675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tacagctgctctagtttccc

SEQ ID NO: 116676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctctagtttcccaaagcctt

SEQ ID NO: 116677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagtttcccaaagccttcca

SEQ ID NO: 116678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtttcccaaagccttccaat

SEQ ID NO: 116679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccaaagccttccaatgaat

SEQ ID NO: 116680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaaagccttccaatgaatg

SEQ ID NO: 116681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaatgaatgcatgagtacc

SEQ ID NO: 116682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caatgaatgcatgagtaccc

SEQ ID NO: 116683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaataaatctccatttggc

SEQ ID NO: 116684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caataaatctccatttggct

SEQ ID NO: 116685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catttggcttgggacagcca

SEQ ID NO: 116686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcttgggacagccagtgtt

SEQ ID NO: 116687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcttgggacagccagtgttt

SEQ ID NO: 116688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gggacagccagtgtttgttt

SEQ ID NO: 116689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggacagccagtgtttgtttc

SEQ ID NO: 116690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttctcttgcttgtaatca

SEQ ID NO: 116691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttctcttgcttgtaatcaa

SEQ ID NO: 116692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcttgcttgtaatcaatat

SEQ ID NO: 116693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttgcttgtaatcaatatc

SEQ ID NO: 116694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgcttgtaatcaatatctt

SEQ ID NO: 116695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcttgtaatcaatatctttg

SEQ ID NO: 116696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttgtaatcaatatctttgc

SEQ ID NO: 116697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaatcaatatctttgctta

SEQ ID NO: 116698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatcaatatctttgcttaa

SEQ ID NO: 116699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcttaatatgagaaattac

SEQ ID NO: 116700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttaatatgagaaattact

SEQ ID NO: 116701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttaatatgagaaattactt

SEQ ID NO: 116702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatatgagaaattacttttg

SEQ ID NO: 116703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatgagaaattacttttgg

SEQ ID NO: 116704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttttggctcactttgtggg

SEQ ID NO: 116705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttggctcactttgtgggaac

SEQ ID NO: 116706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggctcactttgtgggaact

SEQ ID NO: 116707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggctcactttgtgggaacta

SEQ ID NO: 116708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctcactttgtgggaactag

SEQ ID NO: 116709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actttgtgggaactaggtta

SEQ ID NO: 116710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtgggaactaggttatgac

SEQ ID NO: 116711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgggaactaggttatgacc

SEQ ID NO: 116712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgggaactaggttatgacca

SEQ ID NO: 116713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggttatgaccaaaacaagct

SEQ ID NO: 116714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgaccaaaacaagctccttt

SEQ ID NO: 116715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttttggctatgacagtttt

SEQ ID NO: 116716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttggctatgacagttttgct

SEQ ID NO: 116717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggctatgacagttttgcta

SEQ ID NO: 116718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggctatgacagttttgctaa

SEQ ID NO: 116719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctatgacagttttgctaag

SEQ ID NO: 116720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgacagttttgctaagtgat

SEQ ID NO: 116721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctaagtgattaaagcatt

SEQ ID NO: 116722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctaagtgattaaagcattt

SEQ ID NO: 116723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctaagtgattaaagcatttc

SEQ ID NO: 116724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtgattaaagcatttcttc

SEQ ID NO: 116725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagcatttcttctgaatcac

SEQ ID NO: 116726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttctgaatcacttgaaaat

SEQ ID NO: 116727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctgaatcacttgaaaatt

SEQ ID NO: 116728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgaatcacttgaaaattaa

SEQ ID NO: 116729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaatcacttgaaaattaat

SEQ ID NO: 116730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatcacttgaaaattaatca

SEQ ID NO: 116731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaaattaatcacttgacct

SEQ ID NO: 116732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaattaatcacttgacctc

SEQ ID NO: 116733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcacttgacctcagaagta

SEQ ID NO: 116734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacctcagaagtagtgattt

SEQ ID NO: 116735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acctcagaagtagtgattta

SEQ ID NO: 116736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaagtagtgatttaaaaga

SEQ ID NO: 116737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaagaaacataatgcagtc

SEQ ID NO: 116738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagaaacataatgcagtct

SEQ ID NO: 116739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaatgcagaatccatttca

SEQ ID NO: 116740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatattgttcctatcatat

SEQ ID NO: 116741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatattgttcctatcatatt

SEQ ID NO: 116742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttcctatcatattacttctt

SEQ ID NO: 116743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctatcatattacttcttata

SEQ ID NO: 116744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcatattacttcttatacta

SEQ ID NO: 116745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttcttatactataaaatag

SEQ ID NO: 116746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttatactataaaatagata

SEQ ID NO: 116747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatactataaaatagatat

SEQ ID NO: 116748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atactataaaatagatatga

SEQ ID NO: 116749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactataaaatagatatgat

SEQ ID NO: 116750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaaatagatatgatgattt

SEQ ID NO: 116751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctcattatctttattaat

SEQ ID NO: 116752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctcattatctttattaata

SEQ ID NO: 116753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcattatctttattaataa

SEQ ID NO: 116754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attatctttattaataatat

SEQ ID NO: 116755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctttattaataatatttct

SEQ ID NO: 116756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattaataatatttctgcaa

SEQ ID NO: 116757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaataatatttctgcaat

SEQ ID NO: 116758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaataatatttctgcaata

SEQ ID NO: 116759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataatatttctgcaatatcc

SEQ ID NO: 116760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgcaatatccacagtccaa

SEQ ID NO: 116761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcaatatccacagtccaaa

SEQ ID NO: 116762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caatatccacagtccaaaac

SEQ ID NO: 116763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttattttggactaagtccgt

SEQ ID NO: 116764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttggactaagtccgtc

SEQ ID NO: 116765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttggactaagtccgtcc

SEQ ID NO: 116766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttggactaagtccgtcct

SEQ ID NO: 116767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggactaagtccgtccttaa

SEQ ID NO: 116768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggactaagtccgtccttaaa

SEQ ID NO: 116769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gactaagtccgtccttaaaa

SEQ ID NO: 116770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtccgtccttaaaattcac

SEQ ID NO: 116771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaattcactttaaatatac

SEQ ID NO: 116772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattcactttaaatataca

SEQ ID NO: 116773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actttaaatatacacactgc

SEQ ID NO: 116774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaatatacacactgctttt

SEQ ID NO: 116775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatatacacactgctttta

SEQ ID NO: 116776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatatacacactgcttttat

SEQ ID NO: 116777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttttatatcttctacacta

SEQ ID NO: 116778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatatcttctacactatta

SEQ ID NO: 116779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatatcttctacactattat

SEQ ID NO: 116780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatcttctacactattatt

SEQ ID NO: 116781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatcttctacactattattc

SEQ ID NO: 116782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctacactattattcttagtt

SEQ ID NO: 116783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacactattattcttagttt

SEQ ID NO: 116784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cactattattcttagttttt

SEQ ID NO: 116785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttattcttagtttttaaaaa

SEQ ID NO: 116786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcttagtttttaaaaatga

SEQ ID NO: 116787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttagtttttaaaaatgaaat

SEQ ID NO: 116788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtttttaaaaatgaaatca

SEQ ID NO: 116789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtttttaaaaatgaaatcac

SEQ ID NO: 116790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaaatgaaatcacagat

SEQ ID NO: 116791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaatgaaatcacagatg

SEQ ID NO: 116792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaatgaaatcacagatgt

SEQ ID NO: 116793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatgaaatcacagatgta

SEQ ID NO: 116794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaatcttgcaggaccata

SEQ ID NO: 116795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatcttgcaggaccataagc

SEQ ID NO: 116796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcttgcaggaccataagcc

SEQ ID NO: 116797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcaggaccataagccttcca

SEQ ID NO: 116798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caggaccataagccttccat

SEQ ID NO: 116799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccataagcaacctgatgatg

SEQ ID NO: 116800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cataagcaacctgatgatgc

SEQ ID NO: 116801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgatgctaacttactacaa

SEQ ID NO: 116802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acttactacaataaaacaaa

SEQ ID NO: 116803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actacaataaaacaaacttt

SEQ ID NO: 116804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctacaataaaacaaactttc

SEQ ID NO: 116805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caataaaacaaactttcaat

SEQ ID NO: 116806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaatactctaaaatatttt

SEQ ID NO: 116807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatactctaaaatatttta

SEQ ID NO: 116808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatactctaaaatattttaa

SEQ ID NO: 116809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taaaatattttaaaattaaa

SEQ ID NO: 116810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatattttaaaattaaatt

SEQ ID NO: 116811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaattaaattttctttta

SEQ ID NO: 116812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaattaaattttcttttaa

SEQ ID NO: 116813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattaaattttcttttaaa

SEQ ID NO: 116814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattttcttttaaaattata

SEQ ID NO: 116815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttttaaaattatatttta

SEQ ID NO: 116816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttaaaattatattttat

SEQ ID NO: 116817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttaaaattatattttatt

SEQ ID NO: 116818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaaattatattttattat

SEQ ID NO: 116819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaattatattttattata

SEQ ID NO: 116820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaattatattttattatat

SEQ ID NO: 116821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattatattttattatatt

SEQ ID NO: 116822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattttattatatttcaaaa

SEQ ID NO: 116823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattatatttcaaaaatatt

SEQ ID NO: 116824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attatatttcaaaaatattt

SEQ ID NO: 116825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatatttcaaaaatatttt

SEQ ID NO: 116826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatttcaaaaatatttttgt

SEQ ID NO: 116827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaaatatttttgtcctca

SEQ ID NO: 116828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaatatttttgtcctcaa

SEQ ID NO: 116829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtcctcaagaaaatatgg

SEQ ID NO: 116830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtcctcaagaaaatatggc

SEQ ID NO: 116831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcctcaagaaaatatggca

SEQ ID NO: 116832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcctcaagaaaatatggcaa

SEQ ID NO: 116833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagaaaatatggcaaatcca

SEQ ID NO: 116834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttaagaaatataaatag

SEQ ID NO: 116835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaagaaatataaatagt

SEQ ID NO: 116836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagaaatataaatagtata

SEQ ID NO: 116837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagaaatataaatagtataa

SEQ ID NO: 116838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaaatataaatagtataat

SEQ ID NO: 116839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaataataattgtaagaa

SEQ ID NO: 116840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataataattgtaagaatgc

SEQ ID NO: 116841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagaatgctataatatttt

SEQ ID NO: 116842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatattttatcttggtcta

SEQ ID NO: 116843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcttggtctaaaccagtg

SEQ ID NO: 116844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttggtctaaaccagtgg

SEQ ID NO: 116845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttggtctaaaccagtggt

SEQ ID NO: 116846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtctaaaccagtggtcctc

SEQ ID NO: 116847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtctaaaccagtggtcctca

SEQ ID NO: 116848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaccagtggtcctcaacagg

SEQ ID NO: 116849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aacaggataattcttcccta

SEQ ID NO: 116850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttccctacctccaggtggag

SEQ ID NO: 116851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctacctccaggtggagtt

SEQ ID NO: 116852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctacctccaggtggagtta

SEQ ID NO: 116853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctccaggtggagttaccag

SEQ ID NO: 116854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caggtggagttaccagagtt

SEQ ID NO: 116855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccagagttagcaaaaagaat

SEQ ID NO: 116856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaaaaagaatacacagtca

SEQ ID NO: 116857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatttgaattatttatcatt

SEQ ID NO: 116858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaattatttatcattgtgta

SEQ ID NO: 116859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattatttatcattgtgtat

SEQ ID NO: 116860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatcattgtgtatacata

SEQ ID NO: 116861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcattgtgtatacatattc

SEQ ID NO: 116862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcattgtgtatacatattct

SEQ ID NO: 116863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtatacatattctgaccat

SEQ ID NO: 116864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaccataaatggaaatgtt

SEQ ID NO: 116865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
accataaatggaaatgtttt

SEQ ID NO: 116866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttacagaacagtcttaatct

SEQ ID NO: 116867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacagaacagtcttaatctt

SEQ ID NO: 116868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acagaacagtcttaatctta

SEQ ID NO: 116869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagaacagtcttaatcttaa

SEQ ID NO: 116870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatcttaaaatttactaatt

SEQ ID NO: 116871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcttaaaatttactaattg

SEQ ID NO: 116872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaatttactaattgtttat

SEQ ID NO: 116873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatttactaattgtttatc

SEQ ID NO: 116874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actaattgtttatctaaaat

SEQ ID NO: 116875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaattgtttatctaaaata

SEQ ID NO: 116876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attgtttatctaaaataaat

SEQ ID NO: 116877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttatctaaaataaatgatc

SEQ ID NO: 116878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctaaaataaatgatcagt

SEQ ID NO: 116879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctaaaataaatgatcagta

SEQ ID NO: 116880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaataaatgatcagtatgta

SEQ ID NO: 116881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagatttcttttctgaaaat

SEQ ID NO: 116882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttctgaaaatttcctcg

SEQ ID NO: 116883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttctgaaaatttcctcga

SEQ ID NO: 116884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctgaaaatttcctcgatg

SEQ ID NO: 116885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgaaaatttcctcgatga

SEQ ID NO: 116886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaaaatttcctcgatgat

SEQ ID NO: 116887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaaaatttcctcgatgatt

SEQ ID NO: 116888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaatttcctcgatgattgg

SEQ ID NO: 116889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctcgatgattggctttcat

SEQ ID NO: 116890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcgatgattggctttcatt

SEQ ID NO: 116891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gatgattggctttcattaac

SEQ ID NO: 116892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctttcattaacagctcctt

SEQ ID NO: 116893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcattaacagctccttgttt

SEQ ID NO: 116894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattaacagctccttgtttt

SEQ ID NO: 116895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attaacagctccttgttttg

SEQ ID NO: 116896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acagctccttgttttgcaga

SEQ ID NO: 116897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttgttttgcagagttgact

SEQ ID NO: 116898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttttgcagagttgacttat

SEQ ID NO: 116899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttgcagagttgacttata

SEQ ID NO: 116900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcagagttgacttataaaa

SEQ ID NO: 116901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcagagttgacttataaaat

SEQ ID NO: 116902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagagttgacttataaaatt

SEQ ID NO: 116903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acttataaaattccttatag

SEQ ID NO: 116904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataaaattccttatagttaa

SEQ ID NO: 116905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaaattccttatagttaaa

SEQ ID NO: 116906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttatagttaaagcctatgt

SEQ ID NO: 116907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atagttaaagcctatgttcc

SEQ ID NO: 116908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagttaaagcctatgttccc

SEQ ID NO: 116909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagcctatgttccccctaca

SEQ ID NO: 116910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgttccccctacaatgtaac

SEQ ID NO: 116911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccctacaatgtaacatgtc

SEQ ID NO: 116912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caatgtaacatgtcttccat

SEQ ID NO: 116913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccatagtggtcacatccaaa

SEQ ID NO: 116914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catagtggtcacatccaaat

SEQ ID NO: 116915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctcttttctccattcaaca

SEQ ID NO: 116916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcttttctccattcaacat

SEQ ID NO: 116917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttttctccattcaacatt

SEQ ID NO: 116918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttctccattcaacattca

SEQ ID NO: 116919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctccattcaacattcatt

SEQ ID NO: 116920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctccattcaacattcatta

SEQ ID NO: 116921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctccattcaacattcattaa

SEQ ID NO: 116922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccattcaacattcattaat

SEQ ID NO: 116923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cattcaacattcattaatga

SEQ ID NO: 116924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacattcattaatgagaaca

SEQ ID NO: 116925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attaatgagaacatcgtgaa

SEQ ID NO: 116926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgagaacatcgtgaagtcc

SEQ ID NO: 116927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataagtccagcttattgaac

SEQ ID NO: 116928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taagtccagcttattgaaca

SEQ ID NO: 116929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attgaacatgttcagtgtta

SEQ ID NO: 116930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgaacatgttcagtgttag

SEQ ID NO: 116931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacatgttcagtgttagcct

SEQ ID NO: 116932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtgttagccttataagctg

SEQ ID NO: 116933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccttataagctggacttct

SEQ ID NO: 116934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataagctggacttctgaaca

SEQ ID NO: 116935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taagctggacttctgaacat

SEQ ID NO: 116936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gacttctgaacatgtattga

SEQ ID NO: 116937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgaacatgtattgacttaa

SEQ ID NO: 116938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaacatgtattgacttaaa

SEQ ID NO: 116939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacatgtattgacttaaagt

SEQ ID NO: 116940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acttaaagttaactctggga

SEQ ID NO: 116941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaagttaactctgggactta

SEQ ID NO: 116942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagttaactctgggacttac

SEQ ID NO: 116943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actctgggacttactctttt

SEQ ID NO: 116944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgggacttactcttttgcta

SEQ ID NO: 116945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggacttactcttttgctaaa

SEQ ID NO: 116946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actcttttgctaaagaacac

SEQ ID NO: 116947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcttttgctaaagaacaca

SEQ ID NO: 116948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttgctaaagaacacaata

SEQ ID NO: 116949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgctaaagaacacaatacc

SEQ ID NO: 116950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctaaagaacacaatacca

SEQ ID NO: 116951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctaaagaacacaataccat

SEQ ID NO: 116952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctaaagaacacaataccata

SEQ ID NO: 116953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagaacacaataccatattt

SEQ ID NO: 116954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgacataacttgtttttt

SEQ ID NO: 116955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgacataacttgttttttt

SEQ ID NO: 116956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtttttttttatttttcagg

SEQ ID NO: 116957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttttttttatttttcagga

SEQ ID NO: 116958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttatttttcaggatta

SEQ ID NO: 116959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttatttttcaggattag

SEQ ID NO: 116960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttatttttcaggattaga

SEQ ID NO: 116961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttatttttcaggattagat

SEQ ID NO: 116962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatttttcaggattagatt

SEQ ID NO: 116963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttttcaggattagattg

SEQ ID NO: 116964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttttcaggattagattgc

SEQ ID NO: 116965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttcaggattagattgca

SEQ ID NO: 116966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcaggattagattgcatat

SEQ ID NO: 116967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaggattagattgcatatt

SEQ ID NO: 116968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caggattagattgcatattt

SEQ ID NO: 116969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggattagattgcatatttt

SEQ ID NO: 116970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gattgcatattttgatctac

SEQ ID NO: 116971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catattttgatctacaactt

SEQ ID NO: 116972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgatctacaacttttaaaaa

SEQ ID NO: 116973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatctacaacttttaaaaat

SEQ ID NO: 116974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atctacaacttttaaaaata

SEQ ID NO: 116975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caacttttaaaaatattttc

SEQ ID NO: 116976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaaaatattttccactga

SEQ ID NO: 116977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaatattttccactgac

SEQ ID NO: 116978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaatattttccactgaca

SEQ ID NO: 116979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatattttccactgacaa

SEQ ID NO: 116980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccactgacaaaacagaaca

SEQ ID NO: 116981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccactgacaaaacagaacat

SEQ ID NO: 116982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cactgacaaaacagaacatt

SEQ ID NO: 116983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acaaaacagaacattgtcat

SEQ ID NO: 116984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcatgaatttttattccctt

SEQ ID NO: 116985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattcccttctttgagtgc

SEQ ID NO: 116986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattcccttctttgagtgca

SEQ ID NO: 116987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attcccttctttgagtgcat

SEQ ID NO: 116988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcccttctttgagtgcata

SEQ ID NO: 116989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttctttgagtgcatataa

SEQ ID NO: 116990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttgagtgcatataatttc

SEQ ID NO: 116991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttgagtgcatataatttct

SEQ ID NO: 116992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgagtgcatataatttctcc

SEQ ID NO: 116993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagtgcatataatttctcct

SEQ ID NO: 116994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtgcatataatttctcctg

SEQ ID NO: 116995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcctgttccattaaaggat

SEQ ID NO: 116996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctgttccattaaaggatc

SEQ ID NO: 116997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgttccattaaaggatcaa

SEQ ID NO: 116998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttccattaaaggatcaaatt

SEQ ID NO: 116999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattaaaggatcaaattctt

SEQ ID NO: 117000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaggatcaaattcttcaagg

SEQ ID NO: 117001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcaagggataaaatacatt

SEQ ID NO: 117002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caagggataaaatacatttc

SEQ ID NO: 117003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagggataaaatacatttca

SEQ ID NO: 117004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaatatactcatgacaaa

SEQ ID NO: 117005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaatatactcatgacaaat

SEQ ID NO: 117006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgacaaatgtaaaaataat

SEQ ID NO: 117007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccacttcaatacggacttt

SEQ ID NO: 117008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caatacggactttttccctg

SEQ ID NO: 117009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatacggactttttccctgt

SEQ ID NO: 117010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttccctgtccctaagttgt

SEQ ID NO: 117011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccctgtccctaagttgtg

SEQ ID NO: 117012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccctgtccctaagttgtgt

SEQ ID NO: 117013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctgtccctaagttgtgtt

SEQ ID NO: 117014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctgtccctaagttgtgttg

SEQ ID NO: 117015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tccctaagttgtgttgttcc

SEQ ID NO: 117016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agttgtgttgttcctcttaa

SEQ ID NO: 117017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgttgttcctcttaaaacag

SEQ ID NO: 117018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttcctcttaaaacagccttg

SEQ ID NO: 117019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcttaaaacagccttggca

SEQ ID NO: 117020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaaaacagccttggcatac

SEQ ID NO: 117021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaacagccttggcatacaa

SEQ ID NO: 117022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaacagccttggcatacaag

SEQ ID NO: 117023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcatacaagggataaactt

SEQ ID NO: 117024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcatacaagggataaacttt

SEQ ID NO: 117025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcatccattttatctttaa

SEQ ID NO: 117026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatccattttatctttaat

SEQ ID NO: 117027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catccattttatctttaata

SEQ ID NO: 117028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atccattttatctttaatac

SEQ ID NO: 117029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatctttaatacattcaaca

SEQ ID NO: 117030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctttaatacattcaacaa

SEQ ID NO: 117031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctttaatacattcaacaac

SEQ ID NO: 117032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taatacattcaacaactctt

SEQ ID NO: 117033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatacattcaacaactcttt

SEQ ID NO: 117034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atacattcaacaactctttg

SEQ ID NO: 117035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacaactctttgtaagcaat

SEQ ID NO: 117036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttgtaagcaatggagggca

SEQ ID NO: 117037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtaagcaatggagggcatc

SEQ ID NO: 117038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaagcaatggagggcatca

SEQ ID NO: 117039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagcaatggagggcatcaa

SEQ ID NO: 117040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaatgtttactcttctttc

SEQ ID NO: 117041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actcttctttcaaattgcat

SEQ ID NO: 117042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcttctttcaaattgcata

SEQ ID NO: 117043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttctttcaaattgcataatc

SEQ ID NO: 117044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttcaaattgcataatcct

SEQ ID NO: 117045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcaaattgcataatccta

SEQ ID NO: 117046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaaattgcataatcctatt

SEQ ID NO: 117047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaattgcataatcctattg

SEQ ID NO: 117048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaattgcataatcctattgc

SEQ ID NO: 117049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cataatcctattgctaaaag

SEQ ID NO: 117050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgctaaaagatatggaatg

SEQ ID NO: 117051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctaaaagatatggaatgcta

SEQ ID NO: 117052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaagatatggaatgctatga

SEQ ID NO: 117053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgagcaagaaataagtagtc

SEQ ID NO: 117054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tactcaatgggttattttaa

SEQ ID NO: 117055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actcaatgggttattttaaa

SEQ ID NO: 117056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcaatgggttattttaaaa

SEQ ID NO: 117057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatgggttattttaaaagtc

SEQ ID NO: 117058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaaaagtcagcaagaat

SEQ ID NO: 117059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaagtcagcaagaatttg

SEQ ID NO: 117060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaagtcagcaagaatttgt

SEQ ID NO: 117061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagtcagcaagaatttgtg

SEQ ID NO: 117062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgagaccttttcttcagaa

SEQ ID NO: 117063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgagaccttttcttcagaat

SEQ ID NO: 117064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcttcagaattaaagtatg

SEQ ID NO: 117065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttcagaattaaagtatga

SEQ ID NO: 117066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcagaattaaagtatgat

SEQ ID NO: 117067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcagaattaaagtatgatt

SEQ ID NO: 117068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagaattaaagtatgatttc

SEQ ID NO: 117069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaattaaagtatgatttcg

SEQ ID NO: 117070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtatgatttcggtgcttt

SEQ ID NO: 117071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cggtgctttaaataaactaa

SEQ ID NO: 117072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ggtgctttaaataaactaag

SEQ ID NO: 117073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaataaactaagaattctc

SEQ ID NO: 117074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaataaactaagaattctct

SEQ ID NO: 117075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataaactaagaattctctc

SEQ ID NO: 117076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaattctctcaactgcatc

SEQ ID NO: 117077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctcaactgcatctattaaa

SEQ ID NO: 117078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaactgcatctattaaaga

SEQ ID NO: 117079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aactgcatctattaaagaga

SEQ ID NO: 117080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catctattaaagagagccag

SEQ ID NO: 117081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttaaagagagccagtgaatt

SEQ ID NO: 117082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagagagccagtgaatttta

SEQ ID NO: 117083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaatgtgaaagaactgaa

SEQ ID NO: 117084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatgtgaaagaactgaaa

SEQ ID NO: 117085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgtgaaagaactgaaaa

SEQ ID NO: 117086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaataacgaatgccaacaa

SEQ ID NO: 117087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaaaattcttcattagtag

SEQ ID NO: 117088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcattagtagagtctgaac

SEQ ID NO: 117089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattagtagagtctgaacag

SEQ ID NO: 117090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attagtagagtctgaacaga

SEQ ID NO: 117091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtagagtctgaacagaataa

SEQ ID NO: 117092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacagaataaatgctgaaat

SEQ ID NO: 117093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaatagaataatttcttgac

SEQ ID NO: 117094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgacaatttctttactgg

SEQ ID NO: 117095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgacaatttctttactggc

SEQ ID NO: 117096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacaatttctttactggcaa

SEQ ID NO: 117097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acaatttctttactggcaat

SEQ ID NO: 117098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttactggcaattacttta

SEQ ID NO: 117099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttactggcaattactttac

SEQ ID NO: 117100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tactggcaattactttactg

SEQ ID NO: 117101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actggcaattactttactga

SEQ ID NO: 117102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctggcaattactttactgat

SEQ ID NO: 117103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcaattactttactgatatc

SEQ ID NO: 117104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttactgatatcagatgct

SEQ ID NO: 117105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tactgatatcagatgctgtt

SEQ ID NO: 117106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actgatatcagatgctgttt

SEQ ID NO: 117107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgatatcagatgctgtttg

SEQ ID NO: 117108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atatcagatgctgtttgagc

SEQ ID NO: 117109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttgagcagcgtcatgtaga

SEQ ID NO: 117110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagcagcgtcatgtagaata

SEQ ID NO: 117111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agcagcgtcatgtagaatat

SEQ ID NO: 117112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttcatagtcccatttatact

SEQ ID NO: 117113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atagtcccatttatactttg

SEQ ID NO: 117114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atactttgctttaactttca

SEQ ID NO: 117115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactttgctttaactttcaa

SEQ ID NO: 117116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgctttaactttcaataaat

SEQ ID NO: 117117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctttaactttcaataaata

SEQ ID NO: 117118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttaactttcaataaatat

SEQ ID NO: 117119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taactttcaataaatatcac

SEQ ID NO: 117120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactttcaataaatatcaca

SEQ ID NO: 117121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actttcaataaatatcacac

SEQ ID NO: 117122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaataaatatcacaccttt

SEQ ID NO: 117123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caataaatatcacaccttta

SEQ ID NO: 117124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aataaatatcacacctttat

SEQ ID NO: 117125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatgcaaatatccaccaatt

SEQ ID NO: 117126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgcaaatatccaccaattt

SEQ ID NO: 117127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcaaatatccaccaattta

SEQ ID NO: 117128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatttgtattacctccaca

SEQ ID NO: 117129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatttgtattacctccacaa

SEQ ID NO: 117130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtattacctccacaaaataa

SEQ ID NO: 117131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattacctccacaaaataag

SEQ ID NO: 117132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctccacaaaataagtataa

SEQ ID NO: 117133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cacaaaataagtataatttt

SEQ ID NO: 117134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatgactactaactcaatc

SEQ ID NO: 117135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgactactaactcaatca

SEQ ID NO: 117136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgactactaactcaatcat

SEQ ID NO: 117137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgactactaactcaatcata

SEQ ID NO: 117138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaactcaatcatagggtct

SEQ ID NO: 117139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actcaatcatagggtctctg

SEQ ID NO: 117140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatcatagggtctctgcaac

SEQ ID NO: 117141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcaacaatttcttgttgtt

SEQ ID NO: 117142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caacaatttcttgttgtttc

SEQ ID NO: 117143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgttgtttctgaagactc

SEQ ID NO: 117144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgttgtttctgaagactca

SEQ ID NO: 117145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttgtttctgaagactcatc

SEQ ID NO: 117146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgtttctgaagactcatct

SEQ ID NO: 117147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttctgaagactcatctgga

SEQ ID NO: 117148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaagactcatctggaagg

SEQ ID NO: 117149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaagactcatctggaaggc

SEQ ID NO: 117150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagactcatctggaaggcgt

SEQ ID NO: 117151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atctggaaggcgtgttacaa

SEQ ID NO: 117152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaggcgtgttacaatagcc

SEQ ID NO: 117153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caatagccttgtaagcaagt

SEQ ID NO: 117154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaagcaagtctttttatga

SEQ ID NO: 117155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagcaagtctttttatgag

SEQ ID NO: 117156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttatgagaaaattattata

SEQ ID NO: 117157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatgagaaaattattatac

SEQ ID NO: 117158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgagaaaattattatacg

SEQ ID NO: 117159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgagaaaattattatacga

SEQ ID NO: 117160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgagaaaattattatacgag

SEQ ID NO: 117161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatacgagtaaaggaattt

SEQ ID NO: 117162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacgagtaaaggaatttttc

SEQ ID NO: 117163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcccccaaattgtgattac

SEQ ID NO: 117164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcccccaaattgtgattact

SEQ ID NO: 117165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccccaaattgtgattactt

SEQ ID NO: 117166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccccaaattgtgattacttg

SEQ ID NO: 117167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgattacttgcattcatggc

SEQ ID NO: 117168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttgcattcatggctatgcc

SEQ ID NO: 117169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcattcatggctatgccata

SEQ ID NO: 117170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattcatggctatgccataa

SEQ ID NO: 117171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atggctatgccataaaaaag

SEQ ID NO: 117172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgccataaaaaagtaaaaca

SEQ ID NO: 117173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagctgtggtaatctctgta

SEQ ID NO: 117174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agctgtggtaatctctgtaa

SEQ ID NO: 117175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggtaatctctgtaacagta

SEQ ID NO: 117176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtaacagtaaatggagtta

SEQ ID NO: 117177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taacagtaaatggagttatt

SEQ ID NO: 117178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctaatttttattacggca

SEQ ID NO: 117179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taatttttattacggcagta

SEQ ID NO: 117180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttttattacggcagtaga

SEQ ID NO: 117181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattacggcagtagatttt

SEQ ID NO: 117182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattacggcagtagattttg

SEQ ID NO: 117183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attacggcagtagattttgt

SEQ ID NO: 117184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttacggcagtagattttgtc

SEQ ID NO: 117185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cggcagtagattttgtccta

SEQ ID NO: 117186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtcctatagcactagaaaa

SEQ ID NO: 117187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcctatagcactagaaaat

SEQ ID NO: 117188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcctatagcactagaaaatt

SEQ ID NO: 117189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagcactagaaaatttactt

SEQ ID NO: 117190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaaatttacttacaatttt

SEQ ID NO: 117191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttacaattttgcattaaa

SEQ ID NO: 117192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttacaattttgcattaaaa

SEQ ID NO: 117193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acaattttgcattaaaaaat

SEQ ID NO: 117194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caattttgcattaaaaaata

SEQ ID NO: 117195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcattaaaaaatacttgta

SEQ ID NO: 117196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcattaaaaaatacttgtag

SEQ ID NO: 117197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattaaaaaatacttgtagc

SEQ ID NO: 117198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaatacttgtagcacaat

SEQ ID NO: 117199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtagcacaattcaaattaag

SEQ ID NO: 117200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagcacaattcaaattaagt

SEQ ID NO: 117201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaattaagtcatgtgagctt

SEQ ID NO: 117202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtcatgtgagcttaaaacc

SEQ ID NO: 117203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaaccttgtatgatataca

SEQ ID NO: 117204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaccttgtatgatatacaa

SEQ ID NO: 117205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtatgatatacaaagtggaa

SEQ ID NO: 117206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatgatatacaaagtggaag

SEQ ID NO: 117207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgctgcaattattttatct

SEQ ID NO: 117208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgctgcaattattttatctt

SEQ ID NO: 117209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caattattttatcttcttca

SEQ ID NO: 117210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttatcttcttcatctgaa

SEQ ID NO: 117211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcttcttcatctgaattt

SEQ ID NO: 117212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttcttcatctgaatttc

SEQ ID NO: 117213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttcttcatctgaatttct

SEQ ID NO: 117214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttcatctgaatttctttca

SEQ ID NO: 117215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcatctgaatttctttcaa

SEQ ID NO: 117216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catctgaatttctttcaata

SEQ ID NO: 117217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atctgaatttctttcaataa

SEQ ID NO: 117218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatttctttcaataagatgt

SEQ ID NO: 117219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcaataagatgtgattt

SEQ ID NO: 117220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcaataagatgtgatttt

SEQ ID NO: 117221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaataagatgtgattttat

SEQ ID NO: 117222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caataagatgtgattttatt

SEQ ID NO: 117223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aataagatgtgattttatta

SEQ ID NO: 117224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattactttctttggtacaa

SEQ ID NO: 117225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attactttctttggtacaag

SEQ ID NO: 117226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttactttctttggtacaagt

SEQ ID NO: 117227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttctttggtacaagttga

SEQ ID NO: 117228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttggtacaagttgagga

SEQ ID NO: 117229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttggtacaagttgaggaa

SEQ ID NO: 117230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttggtacaagttgaggaaa

SEQ ID NO: 117231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggtacaagttgaggaaatc

SEQ ID NO: 117232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtacaagttgaggaaatca

SEQ ID NO: 117233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtacaagttgaggaaatcat

SEQ ID NO: 117234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggaaatcatacatctattt

SEQ ID NO: 117235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttgcttagctgttagtatt

SEQ ID NO: 117236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttagctgttagtatttgc

SEQ ID NO: 117237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttagctgttagtatttgct

SEQ ID NO: 117238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agctgttagtatttgctggc

SEQ ID NO: 117239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctgttagtatttgctggct

SEQ ID NO: 117240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttagtatttgctggcttaca

SEQ ID NO: 117241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtatttgctggcttacatcc

SEQ ID NO: 117242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctggcttacatccaagttt

SEQ ID NO: 117243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctggcttacatccaagtttt

SEQ ID NO: 117244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcttacatccaagttttcac

SEQ ID NO: 117245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acatccaagttttcaccatt

SEQ ID NO: 117246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catccaagttttcaccattt

SEQ ID NO: 117247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaccattttcaatattagc

SEQ ID NO: 117248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caccattttcaatattagct

SEQ ID NO: 117249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accattttcaatattagcta

SEQ ID NO: 117250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaatattagctaaacaatt

SEQ ID NO: 117251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatattagctaaacaattg

SEQ ID NO: 117252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatattagctaaacaattgt

SEQ ID NO: 117253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctaaacaattgtatgctgc

SEQ ID NO: 117254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacaattgtatgctgcacaa

SEQ ID NO: 117255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatgctgcacaaagagcttc

SEQ ID NO: 117256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cacaaagagcttcaaaagga

SEQ ID NO: 117257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaaaggagtttttctttgt

SEQ ID NO: 117258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaggagtttttctttgtt

SEQ ID NO: 117259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctttgtttaatgcacatc

SEQ ID NO: 117260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttgtttaatgcacatcc

SEQ ID NO: 117261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttgtttaatgcacatcca

SEQ ID NO: 117262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttgtttaatgcacatccat

SEQ ID NO: 117263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtttaatgcacatccattg

SEQ ID NO: 117264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttaatgcacatccattgt

SEQ ID NO: 117265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttaatgcacatccattgtt

SEQ ID NO: 117266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatgcacatccattgttcat

SEQ ID NO: 117267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgcacatccattgttcata

SEQ ID NO: 117268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttcataaaatttatcacaaa

SEQ ID NO: 117269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataaaatttatcacaaaact

SEQ ID NO: 117270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcacaaaacttacttgcat

SEQ ID NO: 117271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcacaaaacttacttgcatt

SEQ ID NO: 117272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acttgcattttgacattttt

SEQ ID NO: 117273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttgcattttgacatttttg

SEQ ID NO: 117274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcattttgacatttttgagt

SEQ ID NO: 117275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattttgacatttttgagtt

SEQ ID NO: 117276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgacatttttgagtttactt

SEQ ID NO: 117277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacatttttgagtttacttc

SEQ ID NO: 117278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acatttttgagtttacttct

SEQ ID NO: 117279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgagtttacttctacacaa

SEQ ID NO: 117280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgagtttacttctacacaaa

SEQ ID NO: 117281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagtttacttctacacaaat

SEQ ID NO: 117282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtttacttctacacaaata

SEQ ID NO: 117283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttctacacaaataaaaaa

SEQ ID NO: 117284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttctacacaaataaaaaat

SEQ ID NO: 117285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctacacaaataaaaaatgga

SEQ ID NO: 117286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacacaaataaaaaatggat

SEQ ID NO: 117287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacaaataaaaaatggatat

SEQ ID NO: 117288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtaattgacccaggaattga

SEQ ID NO: 117289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acccaggaattgaaaagatt

SEQ ID NO: 117290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaagattgaatttgataat

SEQ ID NO: 117291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatttgataatctcacagct

SEQ ID NO: 117292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gataatctcacagctttgtc

SEQ ID NO: 117293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataatctcacagctttgtca

SEQ ID NO: 117294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acagctttgtcactgtcagt

SEQ ID NO: 117295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtcactgtcagtcactcac

SEQ ID NO: 117296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcactgtcagtcactcaca

SEQ ID NO: 117297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcactgtcagtcactcacag

SEQ ID NO: 117298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcagtcactcacaggtacaa

SEQ ID NO: 117299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acaggtacaaactcataact

SEQ ID NO: 117300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataactaaacataaacaaga

SEQ ID NO: 117301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacataaacaagagttgagc

SEQ ID NO: 117302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agccaatgaaaggattgcaa

SEQ ID NO: 117303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaacttgtgaacttacagt

SEQ ID NO: 117304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgaacttacagtaaattga

SEQ ID NO: 117305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaacttacagtaaattgaa

SEQ ID NO: 117306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acagtaaattgaactaaata

SEQ ID NO: 117307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagtaaattgaactaaatat

SEQ ID NO: 117308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aactaaatattggatgccaa

SEQ ID NO: 117309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatattggatgccaaaaatc

SEQ ID NO: 117310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gatgccaaaaatctaaacgt

SEQ ID NO: 117311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacgttctgtttgccagcaa

SEQ ID NO: 117312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtttgccagcaagagagaa

SEQ ID NO: 117313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttgccagcaagagagaact

SEQ ID NO: 117314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccagcaagagagaactgta

SEQ ID NO: 117315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccagcaagagagaactgtat

SEQ ID NO: 117316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatttgtgagagataagttc

SEQ ID NO: 117317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgagagataagttcctgga

SEQ ID NO: 117318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgagagataagttcctggaa

SEQ ID NO: 117319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctggaacaaagccacagctg

SEQ ID NO: 117320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaacaaagccacagctgaca

SEQ ID NO: 117321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acattatataaggtttgggg

SEQ ID NO: 117322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tataaggtttggggaaatgt

SEQ ID NO: 117323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggggaaatgtgcagagtgtt

SEQ ID NO: 117324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggaaatgtgcagagtgttt

SEQ ID NO: 117325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agagactcaaggacttccag

SEQ ID NO: 117326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagactcaaggacttccagc

SEQ ID NO: 117327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaggacttccagctgtgtta

SEQ ID NO: 117328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccagctgtgttagtgtggac

SEQ ID NO: 117329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagctgtgttagtgtggaca

SEQ ID NO: 117330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgttagtgtggacactggag

SEQ ID NO: 117331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgtggacactggagtaaga

SEQ ID NO: 117332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagtaagactgccgttgacc

SEQ ID NO: 117333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccgttgaccttctaaatttt

SEQ ID NO: 117334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
accttctaaattttggaaac

SEQ ID NO: 117335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaaattttggaaacatggt

SEQ ID NO: 117336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaattttggaaacatggtc

SEQ ID NO: 117337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattttggaaacatggtcac

SEQ ID NO: 117338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggaaacatggtcactagag

SEQ ID NO: 117339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaaacatggtcactagagt

SEQ ID NO: 117340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaacatggtcactagagtg

SEQ ID NO: 117341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gagtgggacacttactgatt

SEQ ID NO: 117342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actgattggctgttctctag

SEQ ID NO: 117343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgattggctgttctctagc

SEQ ID NO: 117344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attggctgttctctagcacc

SEQ ID NO: 117345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctgttctctagcaccatag

SEQ ID NO: 117346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttctctagcaccataggggc

SEQ ID NO: 117347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctagcaccataggggcagg

SEQ ID NO: 117348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagcaccataggggcaggca

SEQ ID NO: 117349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcaccataggggcaggcact

SEQ ID NO: 117350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acagggtgatgttcgggact

SEQ ID NO: 117351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gggactgggagtttatcatt

SEQ ID NO: 117352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggagtttatcattagcagac

SEQ ID NO: 117353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcattagcagactttcaaa

SEQ ID NO: 117354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcattagcagactttcaaaa

SEQ ID NO: 117355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcagactttcaaaagcttgg

SEQ ID NO: 117356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaaaagcttggactggcct

SEQ ID NO: 117357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaagcttggactggcctt

SEQ ID NO: 117358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaagcttggactggccttc

SEQ ID NO: 117359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggactggccttcacttgcta

SEQ ID NO: 117360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gactggccttcacttgctaa

SEQ ID NO: 117361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gccttcacttgctaactttc

SEQ ID NO: 117362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacttgctaactttcagaag

SEQ ID NO: 117363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acttgctaactttcagaagc

SEQ ID NO: 117364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctaactttcagaagcatag

SEQ ID NO: 117365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctaactttcagaagcatagt

SEQ ID NO: 117366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actttcagaagcatagttac

SEQ ID NO: 117367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcagaagcatagttactgga

SEQ ID NO: 117368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagaagcatagttactggag

SEQ ID NO: 117369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaagcatagttactggagt

SEQ ID NO: 117370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctggagtgaggcagttattg

SEQ ID NO: 117371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagtgaggcagttattgact

SEQ ID NO: 117372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgactggtttattttcaga

SEQ ID NO: 117373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actggtttattttcagaaac

SEQ ID NO: 117374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtttattttcagaaacatgg

SEQ ID NO: 117375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttcagaaacatggccac

SEQ ID NO: 117376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcagaaacatggccact

SEQ ID NO: 117377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagaaacatggccactgga

SEQ ID NO: 117378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagaaacatggccactggaa

SEQ ID NO: 117379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaaacatggccactggaat

SEQ ID NO: 117380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaatgagaatttcacagatt

SEQ ID NO: 117381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacagatttagctgattttc

SEQ ID NO: 117382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acagatttagctgattttca

SEQ ID NO: 117383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agctgattttcagagcctgt

SEQ ID NO: 117384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctgattttcagagcctgtg

SEQ ID NO: 117385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attttcagagcctgtgtact

SEQ ID NO: 117386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagagcctgtgtactgatt

SEQ ID NO: 117387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagagcctgtgtactgattc

SEQ ID NO: 117388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agagcctgtgtactgattct

SEQ ID NO: 117389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtactgattctgagttaat

SEQ ID NO: 117390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attctgagttaatgataaat

SEQ ID NO: 117391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgagttaatgataaataatg

SEQ ID NO: 117392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agttaatgataaataatgat

SEQ ID NO: 117393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgataaataatgatgatta

SEQ ID NO: 117394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctgttcacaacttgaaact

SEQ ID NO: 117395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttcacaacttgaaacttggg

SEQ ID NO: 117396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaacttgaaacttgggctt

SEQ ID NO: 117397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaacttgggcttaaagacc

SEQ ID NO: 117398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaacttgggcttaaagacca

SEQ ID NO: 117399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gggcttaaagaccattcttt

SEQ ID NO: 117400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggcttaaagaccattctttt

SEQ ID NO: 117401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaagaccattcttttccttt

SEQ ID NO: 117402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagaccattcttttcctttc

SEQ ID NO: 117403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttcctttcttgaatatga

SEQ ID NO: 117404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcctttcttgaatatgaaa

SEQ ID NO: 117405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctttcttgaatatgaaaa

SEQ ID NO: 117406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctttcttgaatatgaaaaa

SEQ ID NO: 117407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttcttgaatatgaaaaat

SEQ ID NO: 117408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttgaatatgaaaaataag

SEQ ID NO: 117409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgaatatgaaaaataagc

SEQ ID NO: 117410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgaatatgaaaaataagca

SEQ ID NO: 117411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaatatgaaaaataagcaca

SEQ ID NO: 117412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatatgaaaaataagcacag

SEQ ID NO: 117413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agcatgtacagagttttttt

SEQ ID NO: 117414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttcttgtcattatttcc

SEQ ID NO: 117415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttcttgtcattatttcct

SEQ ID NO: 117416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcttgtcattatttccta

SEQ ID NO: 117417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttgtcattatttcctaa

SEQ ID NO: 117418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttgtcattatttcctaat

SEQ ID NO: 117419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgtcattatttcctaatg

SEQ ID NO: 117420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgtcattatttcctaatga

SEQ ID NO: 117421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtcattatttcctaatgaat

SEQ ID NO: 117422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcattatttcctaatgaatg

SEQ ID NO: 117423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcctaatgaatgcagaat

SEQ ID NO: 117424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctaatgaatgcagaataac

SEQ ID NO: 117425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctaatgaatgcagaataaca

SEQ ID NO: 117426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgaatgcagaataacaaca

SEQ ID NO: 117427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cattggattaggtattataa

SEQ ID NO: 117428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gattaggtattataagtaat

SEQ ID NO: 117429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtattataagtaatctaga

SEQ ID NO: 117430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taagtaatctagagatgatt

SEQ ID NO: 117431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gagatgatttaaagtatacg

SEQ ID NO: 117432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagtatacggtaggatgtg

SEQ ID NO: 117433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtatacggtaggatgtga

SEQ ID NO: 117434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtgcaaatgttacaccatt

SEQ ID NO: 117435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caccattttatgtaaagaac

SEQ ID NO: 117436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgtaaagaacttgagcat

SEQ ID NO: 117437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgtaaagaacttgagcatc

SEQ ID NO: 117438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtaaagaacttgagcatct

SEQ ID NO: 117439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagcatctccagatttcagt

SEQ ID NO: 117440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agcatctccagatttcagta

SEQ ID NO: 117441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagatttcagtatctcatga

SEQ ID NO: 117442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagtatctcatgaggtccta

SEQ ID NO: 117443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtatctcatgaggtcctag

SEQ ID NO: 117444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgaggtcctagaaccaatc

SEQ ID NO: 117445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaccaatccctcactgata

SEQ ID NO: 117446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actgatactgagggacaatt

SEQ ID NO: 117447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atactgagggacaattgtaa

SEQ ID NO: 117448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agggacaattgtaattgtaa

SEQ ID NO: 117449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taattgtaattttctgcctg

SEQ ID NO: 117450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taattttctgcctgtgcttt

SEQ ID NO: 117451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgcctgtgcttttggtgt

SEQ ID NO: 117452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgcctgtgcttttggtgtt

SEQ ID NO: 117453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcctgtgcttttggtgttc

SEQ ID NO: 117454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctgtgcttttggtgttccc

SEQ ID NO: 117455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgcttttggtgttcccttag

SEQ ID NO: 117456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttggtgttcccttagccaaa

SEQ ID NO: 117457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggtgttcccttagccaaac

SEQ ID NO: 117458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtgttcccttagccaaacc

SEQ ID NO: 117459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgttcccttagccaaacct

SEQ ID NO: 117460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttagccaaacctgctaga

SEQ ID NO: 117461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agccaaacctgctagaaaga

SEQ ID NO: 117462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccaaacctgctagaaagag

SEQ ID NO: 117463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctagaaagaggatagggatt

SEQ ID NO: 117464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaagaggatagggattgta

SEQ ID NO: 117465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaagattctcatttgtaga

SEQ ID NO: 117466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcatttgtagaggtaaacat

SEQ ID NO: 117467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atttgtagaggtaaacattt

SEQ ID NO: 117468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtagaggtaaacattttggc

SEQ ID NO: 117469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagaggtaaacattttggct

SEQ ID NO: 117470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggctaatgttggcatttaa

SEQ ID NO: 117471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggctaatgttggcatttaag

SEQ ID NO: 117472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctaatgttggcatttaagc

SEQ ID NO: 117473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgttggcatttaagcgatt

SEQ ID NO: 117474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcatttaagcgatttaatca

SEQ ID NO: 117475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagcgatttaatcaccaatt

SEQ ID NO: 117476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcgatttaatcaccaatta

SEQ ID NO: 117477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatcaccaattactgtcgca

SEQ ID NO: 117478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcaccaattactgtcgcag

SEQ ID NO: 117479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgtcgcagaaaaatggctc

SEQ ID NO: 117480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcgcagaaaaatggctccaa

SEQ ID NO: 117481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caactgtcaaatttttgtaa

SEQ ID NO: 117482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcaaatttttgtaatttatt

SEQ ID NO: 117483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtaatttattgaaaaaag

SEQ ID NO: 117484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaatttattgaaaaaagc

SEQ ID NO: 117485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaatttattgaaaaaagct

SEQ ID NO: 117486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatttattgaaaaaagcta

SEQ ID NO: 117487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgaaaaaagctaagatac

SEQ ID NO: 117488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgaaaaaagctaagataca

SEQ ID NO: 117489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaaagctaagatacagga

SEQ ID NO: 117490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agatacaggaaatttaggct

SEQ ID NO: 117491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggctgtcttgacaaagcca

SEQ ID NO: 117492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggctgtcttgacaaagccaa

SEQ ID NO: 117493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcttgacaaagccaataaag

SEQ ID NO: 117494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacaaagccaataaagggtg

SEQ ID NO: 117495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acaaagccaataaagggtgc

SEQ ID NO: 117496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catacatttcctagtttcat

SEQ ID NO: 117497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctagtttcatatactgtat

SEQ ID NO: 117498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctagtttcatatactgtata

SEQ ID NO: 117499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtttcatatactgtatagat

SEQ ID NO: 117500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catatactgtatagatatcg

SEQ ID NO: 117501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatactgtatagatatcgg

SEQ ID NO: 117502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatagatatcggactctcct

SEQ ID NO: 117503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcctccctcatgggaacatg

SEQ ID NO: 117504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctccctcatgggaacatgga

SEQ ID NO: 117505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctcatgggaacatggagga

SEQ ID NO: 117506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgggaacatggaggaagaa

SEQ ID NO: 117507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctatggacacctggtgggt

SEQ ID NO: 117508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctatggacacctggtgggta

SEQ ID NO: 117509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggacacctggtgggtagag

SEQ ID NO: 117510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtgggtagaggacagagagg

SEQ ID NO: 117511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctaaagttcctataggaatg

SEQ ID NO: 117512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagttcctataggaatgccc

SEQ ID NO: 117513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctataggaatgcccccaaaa

SEQ ID NO: 117514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taggaatgcccccaaaatcg

SEQ ID NO: 117515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agctgaggttgagaaaccta

SEQ ID NO: 117516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggttgagaaacctatgctt

SEQ ID NO: 117517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaaacctatgcttagacca

SEQ ID NO: 117518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgcttagaccacaatttcac

SEQ ID NO: 117519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaccacaatttcacctgga

SEQ ID NO: 117520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaccacaatttcacctggag

SEQ ID NO: 117521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacctggaggctttttccat

SEQ ID NO: 117522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acctggaggctttttccatt

SEQ ID NO: 117523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaggctttttccatttaaca

SEQ ID NO: 117524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttccatttaacaatgccag

SEQ ID NO: 117525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccatttaacaatgccagg

SEQ ID NO: 117526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccatttaacaatgccaggg

SEQ ID NO: 117527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccatttaacaatgccagggt

SEQ ID NO: 117528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catttaacaatgccagggtc

SEQ ID NO: 117529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacaatgccagggtccttag

SEQ ID NO: 117530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaatgccagggtccttaga

SEQ ID NO: 117531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaacttacttgctcctttg

SEQ ID NO: 117532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaacttacttgctcctttgg

SEQ ID NO: 117533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acttgctcctttggctctaa

SEQ ID NO: 117534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttgctcctttggctctaat

SEQ ID NO: 117535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctcctttggctctaattgc

SEQ ID NO: 117536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcctttggctctaattgct

SEQ ID NO: 117537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctttggctctaattgctttg

SEQ ID NO: 117538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggctctaattgctttgttt

SEQ ID NO: 117539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggctctaattgctttgttta

SEQ ID NO: 117540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctctaattgctttgtttac

SEQ ID NO: 117541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taattgctttgtttacactg

SEQ ID NO: 117542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attgctttgtttacactgta

SEQ ID NO: 117543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttgtttacactgtaaacg

SEQ ID NO: 117544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtttacactgtaaacggcc

SEQ ID NO: 117545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttacactgtaaacggcct

SEQ ID NO: 117546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttacactgtaaacggcctg

SEQ ID NO: 117547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acactgtaaacggcctgaga

SEQ ID NO: 117548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cactgtaaacggcctgagag

SEQ ID NO: 117549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaacggcctgagaggctgg

SEQ ID NO: 117550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaggctggctgggttttta

SEQ ID NO: 117551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctgggtttttagttctata

SEQ ID NO: 117552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtttttagttctatatctt

SEQ ID NO: 117553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagttctatatcttctgag

SEQ ID NO: 117554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagttctatatcttctgaga

SEQ ID NO: 117555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agttctatatcttctgagag

SEQ ID NO: 117556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttctatatcttctgagagg

SEQ ID NO: 117557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatatcttctgagaggtatt

SEQ ID NO: 117558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatcttctgagaggtattct

SEQ ID NO: 117559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgagaggtattctaggctt

SEQ ID NO: 117560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgagaggtattctaggcttc

SEQ ID NO: 117561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaggtattctaggcttcca

SEQ ID NO: 117562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taggcttccaatatatccac

SEQ ID NO: 117563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggcttccaatatatccacca

SEQ ID NO: 117564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaatatatccaccaaggct

SEQ ID NO: 117565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caatatatccaccaaggcta

SEQ ID NO: 117566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atcactaactgttttcagtt

SEQ ID NO: 117567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actgttttcagttgtaatca

SEQ ID NO: 117568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttcagttgtaatcattcc

SEQ ID NO: 117569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagttgtaatcattccagt

SEQ ID NO: 117570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagttgtaatcattccagtg

SEQ ID NO: 117571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agttgtaatcattccagtgt

SEQ ID NO: 117572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatcattccagtgtcatcc

SEQ ID NO: 117573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagtgtcatccagtgattaa

SEQ ID NO: 117574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agctctaagctttggtactc

SEQ ID NO: 117575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taagctttggtactcctttt

SEQ ID NO: 117576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agctttggtactccttttat

SEQ ID NO: 117577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggtactccttttatagtac

SEQ ID NO: 117578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtactccttttatagtaca

SEQ ID NO: 117579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtactccttttatagtacac

SEQ ID NO: 117580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttttatagtacacttaata

SEQ ID NO: 117581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatagtacacttaataaag

SEQ ID NO: 117582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatagtacacttaataaagg

SEQ ID NO: 117583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagtacacttaataaagga

SEQ ID NO: 117584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagtacacttaataaaggat

SEQ ID NO: 117585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aataaaggatacctgtgctg

SEQ ID NO: 117586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataaaggatacctgtgctga

SEQ ID NO: 117587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgctgagttgtagaccctgg

SEQ ID NO: 117588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agttgtagaccctgggcatt

SEQ ID NO: 117589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagaccctgggcattgacac

SEQ ID NO: 117590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcattgacactaactcatt

SEQ ID NO: 117591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acactaactcattggaaaat

SEQ ID NO: 117592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actcattggaaaatattgac

SEQ ID NO: 117593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attggaaaatattgactgat

SEQ ID NO: 117594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaaatattgactgattatt

SEQ ID NO: 117595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actgattattttcattattt

SEQ ID NO: 117596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attattttcattatttttaa

SEQ ID NO: 117597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcattatttttaaggga

SEQ ID NO: 117598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattatttttaagggacta

SEQ ID NO: 117599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattatttttaagggactat

SEQ ID NO: 117600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attatttttaagggactatt

SEQ ID NO: 117601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttaagggactatttcct

SEQ ID NO: 117602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaagggactatttccttaa

SEQ ID NO: 117603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagggactatttccttaac

SEQ ID NO: 117604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagggactatttccttaaca

SEQ ID NO: 117605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agggactatttccttaacaa

SEQ ID NO: 117606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttccttaacaaagaaagtg

SEQ ID NO: 117607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttaacaaagaaagtggag

SEQ ID NO: 117608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttaacaaagaaagtggaga

SEQ ID NO: 117609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacaaagaaagtggagagaa

SEQ ID NO: 117610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaaagaaagtggagagaaa

SEQ ID NO: 117611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaagagattaagcaggaaa

SEQ ID NO: 117612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaagagattaagcaggaaaa

SEQ ID NO: 117613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagagattaagcaggaaaat

SEQ ID NO: 117614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcaggaaaatgatcaagtc

SEQ ID NO: 117615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaaaactcacttttcaca

SEQ ID NO: 117616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaaaactcacttttcacat

SEQ ID NO: 117617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaaactcacttttcacata

SEQ ID NO: 117618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acttttcacatagtctagag

SEQ ID NO: 117619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcacatagtctagagggta

SEQ ID NO: 117620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcacatagtctagagggtaa

SEQ ID NO: 117621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacatagtctagagggtaaa

SEQ ID NO: 117622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acatagtctagagggtaaat

SEQ ID NO: 117623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gagggtaaatttacagcaga

SEQ ID NO: 117624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acagcagaaagatcggttac

SEQ ID NO: 117625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagcagaaagatcggttacc

SEQ ID NO: 117626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccaagtgaataaaactgata

SEQ ID NO: 117627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atatgattggtgggggtatg

SEQ ID NO: 117628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgggggtatggaaacatat

SEQ ID NO: 117629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggtataggtatgtggttac

SEQ ID NO: 117630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catttgaaagataatgaaag

SEQ ID NO: 117631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaagataatgaaaggctgg

SEQ ID NO: 117632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaagataatgaaaggctgga

SEQ ID NO: 117633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaatggcagttgaactcgg

SEQ ID NO: 117634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aactcgggattccagaagtg

SEQ ID NO: 117635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gggattccagaagtgagatg

SEQ ID NO: 117636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagaagtgagatgagcatcc

SEQ ID NO: 117637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttcaggtatctgacttgg

SEQ ID NO: 117638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaggtatctgacttggcct

SEQ ID NO: 117639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caggtatctgacttggcctg

SEQ ID NO: 117640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggtatctgacttggcctgc

SEQ ID NO: 117641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acttggcctgccaagttaat

SEQ ID NO: 117642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcctgccaagttaatactc

SEQ ID NO: 117643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcctgccaagttaatactcc

SEQ ID NO: 117644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccaagttaatactccagtga

SEQ ID NO: 117645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atactccagtgatttcttat

SEQ ID NO: 117646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagtgatttcttatgagagg

SEQ ID NO: 117647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttatgagaggaaactagga

SEQ ID NO: 117648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatgagaggaaactaggag

SEQ ID NO: 117649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgagaggaaactaggagga

SEQ ID NO: 117650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgagaggaaactaggaggat

SEQ ID NO: 117651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggaggatgaggcttaaagaa

SEQ ID NO: 117652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaagaacagggaagaaaaat

SEQ ID NO: 117653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagaacagggaagaaaaatg

SEQ ID NO: 117654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggacatcctgtgtttgaga

SEQ ID NO: 117655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggacatcctgtgtttgagat

SEQ ID NO: 117656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gacatcctgtgtttgagatg

SEQ ID NO: 117657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtttgagatgcctgggaga

SEQ ID NO: 117658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagatgcctgggagacacaa

SEQ ID NO: 117659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agatgcctgggagacacaaa

SEQ ID NO: 117660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggagacacaaagtagacagg

SEQ ID NO: 117661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
accatgttactctggaactt

SEQ ID NO: 117662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctctggaacttaaaatggga

SEQ ID NO: 117663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tggaacttaaaatgggaggc

SEQ ID NO: 117664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaacttaaaatgggaggctg

SEQ ID NO: 117665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaatgggaggctgggttgg

SEQ ID NO: 117666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgggaggctgggttgga

SEQ ID NO: 117667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggttggaaatagtaactttg

SEQ ID NO: 117668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaatagtaactttggagac

SEQ ID NO: 117669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggagacaccagcatataaa

SEQ ID NO: 117670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggagacaccagcatataaag

SEQ ID NO: 117671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagacaccagcatataaaga

SEQ ID NO: 117672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgacattgcccaggaatatt

SEQ ID NO: 117673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacattgcccaggaatattc

SEQ ID NO: 117674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acattgcccaggaatattcc

SEQ ID NO: 117675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccaggaatattcctagtcc

SEQ ID NO: 117676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctagtcccaagaggctaatg

SEQ ID NO: 117677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtcccaagaggctaatggtt

SEQ ID NO: 117678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atggtttttaagaaagacgt

SEQ ID NO: 117679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaagaaagacgtgtacata

SEQ ID NO: 117680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagaaagacgtgtacataa

SEQ ID NO: 117681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagaaagacgtgtacataaa

SEQ ID NO: 117682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaaagacgtgtacataaat

SEQ ID NO: 117683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaatggaagtattttaaaag

SEQ ID NO: 117684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatggaagtattttaaaagt

SEQ ID NO: 117685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaagtaccttggaaacac

SEQ ID NO: 117686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaagtaccttggaaacaca

SEQ ID NO: 117687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagtaccttggaaacacaa

SEQ ID NO: 117688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaaacacaaggggttagaa

SEQ ID NO: 117689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaacacaaggggttagaaa

SEQ ID NO: 117690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaattggtttgagctggta

SEQ ID NO: 117691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtttgagctggtataggaaa

SEQ ID NO: 117692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagctggtataggaaagaag

SEQ ID NO: 117693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agctggtataggaaagaagg

SEQ ID NO: 117694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtataggaaagaaggaaagt

SEQ ID NO: 117695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agttggaattcagcagatgg

SEQ ID NO: 117696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaattcagcagatggatatg

SEQ ID NO: 117697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agcagatggatatggtcgta

SEQ ID NO: 117698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaaaggctgaaaagtgcaa

SEQ ID NO: 117699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaaggctgaaaagtgcaag

SEQ ID NO: 117700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaggctgaaaagtgcaagcc

SEQ ID NO: 117701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaagtgcaagccaggctac

SEQ ID NO: 117702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccttctttttaatccagact

SEQ ID NO: 117703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttttaatccagactccaa

SEQ ID NO: 117704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttaatccagactccaac

SEQ ID NO: 117705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttaatccagactccaacac

SEQ ID NO: 117706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaatccagactccaacact

SEQ ID NO: 117707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatccagactccaacactg

SEQ ID NO: 117708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatccagactccaacactga

SEQ ID NO: 117709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atccagactccaacactgaa

SEQ ID NO: 117710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caacactgaaaagctaggtc

SEQ ID NO: 117711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaagctaggtcaccttagt

SEQ ID NO: 117712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtcaccttagttaagttac

SEQ ID NO: 117713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agttaagttacttaactgtg

SEQ ID NO: 117714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttaagttacttaactgtgt

SEQ ID NO: 117715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agttacttaactgtgtatct

SEQ ID NO: 117716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttaactgtgtatctcagtt

SEQ ID NO: 117717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aactgtgtatctcagtttac

SEQ ID NO: 117718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actgtgtatctcagtttact

SEQ ID NO: 117719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtatctcagtttactcatc

SEQ ID NO: 117720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agtttactcatcggtaaaat

SEQ ID NO: 117721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actcatcggtaaaatgagta

SEQ ID NO: 117722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcatcggtaaaatgagtat

SEQ ID NO: 117723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atcggtaaaatgagtatgaa

SEQ ID NO: 117724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaatatttaaatgagttaa

SEQ ID NO: 117725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaatatttaaatgagttaat

SEQ ID NO: 117726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatatttaaatgagttaatg

SEQ ID NO: 117727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatgagttaatgcatataa

SEQ ID NO: 117728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgagttaatgcatataaa

SEQ ID NO: 117729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgcatataaacactctaga

SEQ ID NO: 117730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagaatcatacttgaaccaa

SEQ ID NO: 117731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaatcatacttgaaccaata

SEQ ID NO: 117732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaccaataagaactcaata

SEQ ID NO: 117733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaccaataagaactcaatac

SEQ ID NO: 117734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatacatacctctattattg

SEQ ID NO: 117735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tattattgttattatcatta

SEQ ID NO: 117736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttattgttattatcattatt

SEQ ID NO: 117737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgttattatcattattagg

SEQ ID NO: 117738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttattatcattattaggcag

SEQ ID NO: 117739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatcattattaggcagggg

SEQ ID NO: 117740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcattattaggcagggggag

SEQ ID NO: 117741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaggcagggggagttaaat

SEQ ID NO: 117742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggcagggggagttaaataaa

SEQ ID NO: 117743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataaactgacacataaatg

SEQ ID NO: 117744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acacataaatgcttcaaaat

SEQ ID NO: 117745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaaatgtacacagcaagtt

SEQ ID NO: 117746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaatgtacacagcaagtta

SEQ ID NO: 117747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggaaataagaagaggtcta

SEQ ID NO: 117748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggactacttggcagcactc

SEQ ID NO: 117749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttggcagcactcttcccag

SEQ ID NO: 117750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcagcactcttcccaggat

SEQ ID NO: 117751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcagcactcttcccaggata

SEQ ID NO: 117752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcccaggatacaagagaga

SEQ ID NO: 117753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccaggatacaagagagaaa

SEQ ID NO: 117754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaggatacaagagagaaac

SEQ ID NO: 117755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaaacggaggagtagtgcc

SEQ ID NO: 117756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaacggaggagtagtgcca

SEQ ID NO: 117757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaacggaggagtagtgccag

SEQ ID NO: 117758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccttgtatgggagtctttt

SEQ ID NO: 117759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttgtatgggagtcttttca

SEQ ID NO: 117760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtatgggagtcttttcagca

SEQ ID NO: 117761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatgggagtcttttcagcaa

SEQ ID NO: 117762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcagcaattttgcagcaat

SEQ ID NO: 117763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagcaattttgcagcaatc

SEQ ID NO: 117764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagcaattttgcagcaatcc

SEQ ID NO: 117765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agcaattttgcagcaatcca

SEQ ID NO: 117766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcagcaatccatgcagcaa

SEQ ID NO: 117767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcagcaatccatgcagcaaa

SEQ ID NO: 117768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagcaatccatgcagcaaag

SEQ ID NO: 117769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgcaaatacaaggagatgag

SEQ ID NO: 117770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agcagttgtgggagttgccc

SEQ ID NO: 117771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgggagttgccctgcttcaa

SEQ ID NO: 117772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccctgcttcaaaattgcttg

SEQ ID NO: 117773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttcaaaattgcttgtctca

SEQ ID NO: 117774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaaattgcttgtctcacat

SEQ ID NO: 117775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaattgcttgtctcacatg

SEQ ID NO: 117776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttgtctcacatgaaccctt

SEQ ID NO: 117777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtctcacatgaacccttatc

SEQ ID NO: 117778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctcacatgaacccttatca

SEQ ID NO: 117779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acatgaacccttatcaattg

SEQ ID NO: 117780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atcaattgtaacaactgcaa

SEQ ID NO: 117781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaattgtaacaactgcaac

SEQ ID NO: 117782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taacaactgcaactctgtat

SEQ ID NO: 117783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caactctgtatgaaagggac

SEQ ID NO: 117784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtatgaaagggacatgccc

SEQ ID NO: 117785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatgaaagggacatgcccac

SEQ ID NO: 117786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acaggagtcactgcattaag

SEQ ID NO: 117787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caggagtcactgcattaagg

SEQ ID NO: 117788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cattaagggggttccaaaga

SEQ ID NO: 117789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agggggttccaaagaaagat

SEQ ID NO: 117790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaagaaagatgacaccctc

SEQ ID NO: 117791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggcattgatttagggcttat

SEQ ID NO: 117792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atttagggcttatttttttt

SEQ ID NO: 117793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agggcttatttttttttctc

SEQ ID NO: 117794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gggcttatttttttttctct

SEQ ID NO: 117795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttttttttctctttcggt

SEQ ID NO: 117796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttttttctctttcggtg

SEQ ID NO: 117797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttctctttcggtgctc

SEQ ID NO: 117798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttctctttcggtgctct

SEQ ID NO: 117799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttctctttcggtgctctt

SEQ ID NO: 117800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctctttcggtgctcttt

SEQ ID NO: 117801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctctttcggtgctcttta

SEQ ID NO: 117802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctctttcggtgctctttat

SEQ ID NO: 117803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctttcggtgctctttata

SEQ ID NO: 117804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctttcggtgctctttatat

SEQ ID NO: 117805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttcggtgctctttatatta

SEQ ID NO: 117806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcggtgctctttatattaaa

SEQ ID NO: 117807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cggtgctctttatattaaaa

SEQ ID NO: 117808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ggtgctctttatattaaaat

SEQ ID NO: 117809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttatattaaaattatacaa

SEQ ID NO: 117810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatattaaaattatacaaga

SEQ ID NO: 117811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atattaaaattatacaagat

SEQ ID NO: 117812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattaaaattatacaagata

SEQ ID NO: 117813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattatacaagatattact

SEQ ID NO: 117814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacaagatattactattact

SEQ ID NO: 117815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctattactatctgtctaacg

SEQ ID NO: 117816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttactatctgtctaacgccc

SEQ ID NO: 117817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctatctgtctaacgcccatg

SEQ ID NO: 117818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctgtctaacgcccatgtgt

SEQ ID NO: 117819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctaacgcccatgtgtacaa

SEQ ID NO: 117820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acgcccatgtgtacaaaaac

SEQ ID NO: 117821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatacttatgctatttgttg

SEQ ID NO: 117822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tacttatgctatttgttggc

SEQ ID NO: 117823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgctatttgttggcttctc

SEQ ID NO: 117824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgctatttgttggcttctcc

SEQ ID NO: 117825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttgttggcttctcctctct

SEQ ID NO: 117826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttggcttctcctctctcca

SEQ ID NO: 117827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttggcttctcctctctccat

SEQ ID NO: 117828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcttctcctctctccataac

SEQ ID NO: 117829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcctctctccataactttt

SEQ ID NO: 117830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctctctccataactttta

SEQ ID NO: 117831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctctctccataacttttatt

SEQ ID NO: 117832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctccataacttttatttgt

SEQ ID NO: 117833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tccataacttttatttgttt

SEQ ID NO: 117834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cataacttttatttgttttt

SEQ ID NO: 117835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatttgttttttaaatttt

SEQ ID NO: 117836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttgttttttaaattttt

SEQ ID NO: 117837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttgttttttaaatttttt

SEQ ID NO: 117838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgttttttaaatttttta

SEQ ID NO: 117839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttttttaaattttttattg

SEQ ID NO: 117840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttttaaattttttattgt

SEQ ID NO: 117841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaattttttattgtgag

SEQ ID NO: 117842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaattttttattgtgagc

SEQ ID NO: 117843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaattttttattgtgagct

SEQ ID NO: 117844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattttttattgtgagcta

SEQ ID NO: 117845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattttttattgtgagctaa

SEQ ID NO: 117846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttattgtgagctaattata

SEQ ID NO: 117847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattgtgagctaattatag

SEQ ID NO: 117848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattgtgagctaattatagg

SEQ ID NO: 117849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgtgagctaattatagga

SEQ ID NO: 117850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgtgagctaattataggaa

SEQ ID NO: 117851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgagctaattataggaaagg

SEQ ID NO: 117852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attataggaaaggagcaaaa

SEQ ID NO: 117853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taggaaaggagcaaaaatag

SEQ ID NO: 117854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatattcccttgtaccccct

SEQ ID NO: 117855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttgtaccccctgccccac

SEQ ID NO: 117856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaccccctgccccacttcc

SEQ ID NO: 117857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taccccctgccccacttcct

SEQ ID NO: 117858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccccacttcctataatgtta

SEQ ID NO: 117859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctataatgttaacaattat

SEQ ID NO: 117860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctataatgttaacaattata

SEQ ID NO: 117861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatgttaacaattatataa

SEQ ID NO: 117862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaattatataaccatagta

SEQ ID NO: 117863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tataaccatagtaatcaaga

SEQ ID NO: 117864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaccagtatgatattacta

SEQ ID NO: 117865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctatctgaattgcaaatctt

SEQ ID NO: 117866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctgaattgcaaatcttact

SEQ ID NO: 117867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aattgcaaatcttacttaaa

SEQ ID NO: 117868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaatcttacttaaattaca

SEQ ID NO: 117869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acttaaattacatcattttt

SEQ ID NO: 117870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttaaattacatcatttttt

SEQ ID NO: 117871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaattacatcattttttatt

SEQ ID NO: 117872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattacatcattttttattg

SEQ ID NO: 117873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catcattttttattgcattt

SEQ ID NO: 117874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttattgcatttagttgtta

SEQ ID NO: 117875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattgcatttagttgttat

SEQ ID NO: 117876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattgcatttagttgttata

SEQ ID NO: 117877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgcatttagttgttatac

SEQ ID NO: 117878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgcatttagttgttatacc

SEQ ID NO: 117879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catttagttgttatacctca

SEQ ID NO: 117880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agttgttatacctcattagt

SEQ ID NO: 117881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttgttatacctcattagtc

SEQ ID NO: 117882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttatacctcattagtctctt

SEQ ID NO: 117883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacctcattagtctcttttt

SEQ ID NO: 117884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attagtctctttttatctgc

SEQ ID NO: 117885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtctctttttatctgcaaca

SEQ ID NO: 117886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttttatctgcaacagaact

SEQ ID NO: 117887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttatctgcaacagaacttc

SEQ ID NO: 117888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatctgcaacagaacttca

SEQ ID NO: 117889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatctgcaacagaacttcaa

SEQ ID NO: 117890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctgcaacagaacttcaat

SEQ ID NO: 117891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgcaacagaacttcaatt

SEQ ID NO: 117892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caacagaacttcaattgttt

SEQ ID NO: 117893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caattgttttcttttctttc

SEQ ID NO: 117894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aattgttttcttttctttcg

SEQ ID NO: 117895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttcttttctttcgtgacc

SEQ ID NO: 117896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttttctttcgtgacctga

SEQ ID NO: 117897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttctttcgtgacctgac

SEQ ID NO: 117898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttctttcgtgacctgaca

SEQ ID NO: 117899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctttcgtgacctgacaat

SEQ ID NO: 117900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttcgtgacctgacaatt

SEQ ID NO: 117901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcgtgacctgacaattg

SEQ ID NO: 117902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcgtgacctgacaattgg

SEQ ID NO: 117903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcgtgacctgacaattgggc

SEQ ID NO: 117904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgtgacctgacaattgggca

SEQ ID NO: 117905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gtgacctgacaattgggcag

SEQ ID NO: 117906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acaattgggcagaatacaaa

SEQ ID NO: 117907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggcagaatacaaatcagtta

SEQ ID NO: 117908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttgtagaatgcgtctcaa

SEQ ID NO: 117909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtagaatgcgtctcaactt

SEQ ID NO: 117910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtagaatgcgtctcaacttg

SEQ ID NO: 117911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagaatgcgtctcaacttgg

SEQ ID NO: 117912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aacttgggttcactgaattt

SEQ ID NO: 117913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gggttcactgaatttttcaa

SEQ ID NO: 117914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggttcactgaatttttcaat

SEQ ID NO: 117915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actgaatttttcaattcaca

SEQ ID NO: 117916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatttttcaattcacaacta

SEQ ID NO: 117917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcaattcacaactaaggaa

SEQ ID NO: 117918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaattcacaactaaggaaa

SEQ ID NO: 117919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caattcacaactaaggaaac

SEQ ID NO: 117920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aattcacaactaaggaaact

SEQ ID NO: 117921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaactaaggaaactaaagc

SEQ ID NO: 117922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aggaaactaaagcgttatct

SEQ ID NO: 117923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagcgttatctatggaatta

SEQ ID NO: 117924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctatggaattagatacttt

SEQ ID NO: 117925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggaattagatactttgctc

SEQ ID NO: 117926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatactttgctcaaggtaac

SEQ ID NO: 117927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgctcaaggtaacacagctg

SEQ ID NO: 117928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctcaaggtaacacagctgt

SEQ ID NO: 117929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcaaggtaacacagctgtg

SEQ ID NO: 117930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaggtaacacagctgtgtgt

SEQ ID NO: 117931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtgtagcagagccaggatt

SEQ ID NO: 117932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaactaagatctgttactcc

SEQ ID NO: 117933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aactaagatctgttactccc

SEQ ID NO: 117934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agatctgttactccccaggc

SEQ ID NO: 117935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttactccccaggccagtata

SEQ ID NO: 117936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctccccaggccagtatagaa

SEQ ID NO: 117937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cccaggccagtatagaaaaa

SEQ ID NO: 117938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaggaaggatgttttaaaac

SEQ ID NO: 117939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaactttaaaatgcagaa

SEQ ID NO: 117940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaactttaaaatgcagaaa

SEQ ID NO: 117941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaactttaaaatgcagaaat

SEQ ID NO: 117942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaaatgcagaaatacatgg

SEQ ID NO: 117943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatgcagaaatacatggc

SEQ ID NO: 117944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgcagaaatacatggct

SEQ ID NO: 117945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agagtatgtacctgttgcaa

SEQ ID NO: 117946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagtatgtacctgttgcaaa

SEQ ID NO: 117947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgcaaaggtcttggcatct

SEQ ID NO: 117948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaaggtcttggcatctgaa

SEQ ID NO: 117949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcatctgaatttttatcga

SEQ ID NO: 117950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcatctgaatttttatcgat

SEQ ID NO: 117951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatttttatcgatgactcat

SEQ ID NO: 117952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatcgatgactcatttggc

SEQ ID NO: 117953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcgatgactcatttggct

SEQ ID NO: 117954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcgatgactcatttggctt

SEQ ID NO: 117955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcgatgactcatttggcttt

SEQ ID NO: 117956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atttggctttattcagcaga

SEQ ID NO: 117957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggctttattcagcagacttg

SEQ ID NO: 117958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctttattcagcagacttga

SEQ ID NO: 117959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattcagcagacttgagttt

SEQ ID NO: 117960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attcagcagacttgagttta

SEQ ID NO: 117961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcagcagacttgagtttag

SEQ ID NO: 117962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agcagacttgagtttagaaa

SEQ ID NO: 117963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagtttagaaattcaatcag

SEQ ID NO: 117964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtttagaaattcaatcagt

SEQ ID NO: 117965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaaattcaatcagtgagta

SEQ ID NO: 117966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaattcaatcagtgagtag

SEQ ID NO: 117967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatcagtgagtagtttatct

SEQ ID NO: 117968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctggtaaactgtccttgt

SEQ ID NO: 117969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctggtaaactgtccttgta

SEQ ID NO: 117970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtaaactgtccttgtaatta

SEQ ID NO: 117971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tccttgtaattaaataaaac

SEQ ID NO: 117972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaattaaataaaacaatcc

SEQ ID NO: 117973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taattaaataaaacaatccc

SEQ ID NO: 117974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataaaacaatccccaggaa

SEQ ID NO: 117975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attgaaaaaagcctgcccat

SEQ ID NO: 117976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaaagcctgcccatcagg

SEQ ID NO: 117977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cccatcaggaacacctagaa

SEQ ID NO: 117978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaagccacgctttgttggtc

SEQ ID NO: 117979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgttggtctgtttaagccaa

SEQ ID NO: 117980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttggtctgtttaagccaaa

SEQ ID NO: 117981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttggtctgtttaagccaaat

SEQ ID NO: 117982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtctgtttaagccaaatttc

SEQ ID NO: 117983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttaagccaaatttctggca

SEQ ID NO: 117984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagccaaatttctggcacac

SEQ ID NO: 117985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agccaaatttctggcacact

SEQ ID NO: 117986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctggcacactgctcttcgga

SEQ ID NO: 117987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggcacactgctcttcggaa

SEQ ID NO: 117988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcacactgctcttcggaaat

SEQ ID NO: 117989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctcttcggaaatcaaattta

SEQ ID NO: 117990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcggaaatcaaatttaaaa

SEQ ID NO: 117991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cggaaatcaaatttaaaatg

SEQ ID NO: 117992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ggaaatcaaatttaaaatga

SEQ ID NO: 117993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatgacaggtaagttggt

SEQ ID NO: 117994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgacaggtaagttggtc

SEQ ID NO: 117995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtcttaactttcttaaaggc

SEQ ID NO: 117996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aactttcttaaaggcacaaa

SEQ ID NO: 117997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actttcttaaaggcacaaac

SEQ ID NO: 117998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttaaaggcacaaacaagt

SEQ ID NO: 117999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttaaaggcacaaacaagta

SEQ ID NO: 118000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaaaggcacaaacaagtaa

SEQ ID NO: 118001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaggcacaaacaagtaata

SEQ ID NO: 118002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaggcacaaacaagtaatag

SEQ ID NO: 118003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actctctgatatataatgta

SEQ ID NO: 118004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctgatatataatgtatcac

SEQ ID NO: 118005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgatatataatgtatcacag

SEQ ID NO: 118006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atatataatgtatcacagaa

SEQ ID NO: 118007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atttcacatgtagtggcctt

SEQ ID NO: 118008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacatgtagtggccttttat

SEQ ID NO: 118009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acatgtagtggccttttatc

SEQ ID NO: 118010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatcaacagcaacataatt

SEQ ID NO: 118011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcaacagcaacataattt

SEQ ID NO: 118012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcaacagcaacataatttg

SEQ ID NO: 118013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaacagcaacataatttgg

SEQ ID NO: 118014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggaatttctaaatttttaa

SEQ ID NO: 118015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaatttctaaatttttaat

SEQ ID NO: 118016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaaatttttaatttagatc

SEQ ID NO: 118017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaatttttaatttagatct

SEQ ID NO: 118018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatttttaatttagatctta

SEQ ID NO: 118019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaatttagatcttacttta

SEQ ID NO: 118020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatttagatcttactttaa

SEQ ID NO: 118021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttagatcttactttaag

SEQ ID NO: 118022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttagatcttactttaaga

SEQ ID NO: 118023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agatcttactttaagatatg

SEQ ID NO: 118024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatcttactttaagatatga

SEQ ID NO: 118025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actttaagatatgaaaaaat

SEQ ID NO: 118026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttaagatatgaaaaaata

SEQ ID NO: 118027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taagatatgaaaaaatagga

SEQ ID NO: 118028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagatatgaaaaaataggag

SEQ ID NO: 118029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agatatgaaaaaataggagg

SEQ ID NO: 118030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatgcctggggaaagacatg

SEQ ID NO: 118031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gggaaagacatgcatgttct

SEQ ID NO: 118032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttagaattttgttagaatgt

SEQ ID NO: 118033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaattttgttagaatgtaa

SEQ ID NO: 118034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaattttgttagaatgtaat

SEQ ID NO: 118035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttagaatgtaatgagtcc

SEQ ID NO: 118036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttagaatgtaatgagtccc

SEQ ID NO: 118037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttagaatgtaatgagtccct

SEQ ID NO: 118038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatgtaatgagtccctatg

SEQ ID NO: 118039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtcctagtatttttataga

SEQ ID NO: 118040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtatttttatagactccctc

SEQ ID NO: 118041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatagactccctctgttaa

SEQ ID NO: 118042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatagactccctctgttaac

SEQ ID NO: 118043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagactccctctgttaact

SEQ ID NO: 118044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagactccctctgttaacta

SEQ ID NO: 118045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctctgttaactataatgaa

SEQ ID NO: 118046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgttaactataatgaattta

SEQ ID NO: 118047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttaactataatgaatttagg

SEQ ID NO: 118048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actataatgaatttaggaag

SEQ ID NO: 118049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatgaatttaggaaggtgg

SEQ ID NO: 118050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggaaggtgggtgagaaggt

SEQ ID NO: 118051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaaggtgggtgagaaggtg

SEQ ID NO: 118052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattctctttcaccccaata

SEQ ID NO: 118053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attctctttcaccccaataa

SEQ ID NO: 118054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctctttcaccccaataaa

SEQ ID NO: 118055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctttcaccccaataaatga

SEQ ID NO: 118056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttcaccccaataaatgata

SEQ ID NO: 118057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaccccaataaatgatatc

SEQ ID NO: 118058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caccccaataaatgatatca

SEQ ID NO: 118059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accccaataaatgatatcaa

SEQ ID NO: 118060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatttaaattaacaaaaact

SEQ ID NO: 118061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattaacaaaaactggagt

SEQ ID NO: 118062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattaacaaaaactggagtc

SEQ ID NO: 118063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaaaaactggagtccctgg

SEQ ID NO: 118064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagtccctggcacctgaaca

SEQ ID NO: 118065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcacctgaacaagtgcttgc

SEQ ID NO: 118066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacaagtgcttgctcaaaca

SEQ ID NO: 118067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctcaaacagtatttgttaa

SEQ ID NO: 118068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcaaacagtatttgttaat

SEQ ID NO: 118069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaacagtatttgttaattac

SEQ ID NO: 118070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttaattacttgtaaatgta

SEQ ID NO: 118071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaattacttgtaaatgtag

SEQ ID NO: 118072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attacttgtaaatgtagcac

SEQ ID NO: 118073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttgtaaatgtagcacttca

SEQ ID NO: 118074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaaatgtagcacttcaagg

SEQ ID NO: 118075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaatgtagcacttcaagga

SEQ ID NO: 118076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaggaggagagttaatagt

SEQ ID NO: 118077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaggaggagagttaatagta

SEQ ID NO: 118078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atagtataaaggttacctta

SEQ ID NO: 118079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccttaaaatcagacttttaa

SEQ ID NO: 118080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaatcagacttttaaatta

SEQ ID NO: 118081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatcagacttttaaattaa

SEQ ID NO: 118082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaattaaataacttctat

SEQ ID NO: 118083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaattaaataacttctatg

SEQ ID NO: 118084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattaaataacttctatgt

SEQ ID NO: 118085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattaaataacttctatgta

SEQ ID NO: 118086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataacttctatgtaataat

SEQ ID NO: 118087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctatgtaataatatggtgga

SEQ ID NO: 118088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatgtaataatatggtggaa

SEQ ID NO: 118089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtaataatatggtggaaaa

SEQ ID NO: 118090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtgtagaatatggaatttc

SEQ ID NO: 118091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgtagaatatggaatttct

SEQ ID NO: 118092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcctgacatttctctttga

SEQ ID NO: 118093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctgacatttctctttgaa

SEQ ID NO: 118094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgacatttctctttgaaat

SEQ ID NO: 118095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acatttctctttgaaattta

SEQ ID NO: 118096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctttgaaatttaattcta

SEQ ID NO: 118097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctttgaaatttaattctac

SEQ ID NO: 118098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttgaaatttaattctacta

SEQ ID NO: 118099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaaatttaattctactatc

SEQ ID NO: 118100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaatttaattctactatct

SEQ ID NO: 118101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatttaattctactatcta

SEQ ID NO: 118102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattctactatctagagagg

SEQ ID NO: 118103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attctactatctagagaggt

SEQ ID NO: 118104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tactatctagagaggtagca

SEQ ID NO: 118105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctatctagagaggtagcata

SEQ ID NO: 118106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctagagaggtagcatattg

SEQ ID NO: 118107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gagaggtagcatattgtagg

SEQ ID NO: 118108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taggaaattataagtccaaa

SEQ ID NO: 118109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taagtccaaatgttggcttt

SEQ ID NO: 118110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctttaccactcttgtatga

SEQ ID NO: 118111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taccactcttgtatgaacct

SEQ ID NO: 118112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
accactcttgtatgaacctg

SEQ ID NO: 118113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccactcttgtatgaacctga

SEQ ID NO: 118114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgtatgaacctgagtaaat

SEQ ID NO: 118115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtatgaacctgagtaaatga

SEQ ID NO: 118116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatgaacctgagtaaatgat

SEQ ID NO: 118117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtaaatgatttaacctcag

SEQ ID NO: 118118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacctcaggaactatgtctc

SEQ ID NO: 118119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acctcaggaactatgtctcc

SEQ ID NO: 118120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggaactatgtctcctattt

SEQ ID NO: 118121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtctcctatttcactggtg

SEQ ID NO: 118122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctatttcactggtgaggaag

SEQ ID NO: 118123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttcactggtgaggaagtta

SEQ ID NO: 118124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cactggtgaggaagttacac

SEQ ID NO: 118125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actggtgaggaagttacacg

SEQ ID NO: 118126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtgaggaagttacacgggta

SEQ ID NO: 118127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacgggtagtctgttagaaa

SEQ ID NO: 118128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttagaaagaggggatgaagt

SEQ ID NO: 118129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaagaggggatgaagtaag

SEQ ID NO: 118130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctagggtttactctacagt

SEQ ID NO: 118131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gggtttactctacagtatta

SEQ ID NO: 118132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actctacagtattacagctt

SEQ ID NO: 118133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctctacagtattacagcttg

SEQ ID NO: 118134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tacagtattacagcttgaaa

SEQ ID NO: 118135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagtattacagcttgaaaac

SEQ ID NO: 118136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagcttgaaaacaaagaaaa

SEQ ID NO: 118137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaaacaaagaaaagagaaa

SEQ ID NO: 118138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaacaaagaaaagagaaaa

SEQ ID NO: 118139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttaatgaaaatgagtgaag

SEQ ID NO: 118140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatgaaaatgagtgaagaca

SEQ ID NO: 118141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgaaaatgagtgaagacaa

SEQ ID NO: 118142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaataacacatcttgggaag

SEQ ID NO: 118143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gggaagaatgtactcagaaa

SEQ ID NO: 118144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaagaatgtactcagaaat

SEQ ID NO: 118145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaaattttataatttataa

SEQ ID NO: 118146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tataatttataattatctga

SEQ ID NO: 118147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataatttataattatctgag

SEQ ID NO: 118148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatttataattatctgaga

SEQ ID NO: 118149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataattatctgagaaatata

SEQ ID NO: 118150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taattatctgagaaatataa

SEQ ID NO: 118151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgagaaatataatctata

SEQ ID NO: 118152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaaatataatctataattt

SEQ ID NO: 118153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatttatatcgactatttg

SEQ ID NO: 118154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatcgactatttgacatgg

SEQ ID NO: 118155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatcgactatttgacatggg

SEQ ID NO: 118156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttgacatgggttttctttc

SEQ ID NO: 118157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacatgggttttctttcaaa

SEQ ID NO: 118158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acatgggttttctttcaaaa

SEQ ID NO: 118159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttcaaaacatgccattt

SEQ ID NO: 118160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcaaaacatgccatttt

SEQ ID NO: 118161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcaaaacatgccatttta

SEQ ID NO: 118162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaaaacatgccattttaac

SEQ ID NO: 118163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaacatgccattttaaca

SEQ ID NO: 118164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaacatgccattttaacat

SEQ ID NO: 118165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacattgacatatctatta

SEQ ID NO: 118166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacattgacatatctattac

SEQ ID NO: 118167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acattgacatatctattact

SEQ ID NO: 118168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acatatctattacttgaagg

SEQ ID NO: 118169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttacttgaaggtcaagtaca

SEQ ID NO: 118170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttgaaggtcaagtacaagt

SEQ ID NO: 118171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaggtcaagtacaagtgca

SEQ ID NO: 118172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaggtcaagtacaagtgcat

SEQ ID NO: 118173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taccaaatagtgtttccaca

SEQ ID NO: 118174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
accaaatagtgtttccacat

SEQ ID NO: 118175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccaaatagtgtttccacatt

SEQ ID NO: 118176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccacattgattgcaaaacta

SEQ ID NO: 118177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacattgattgcaaaactac

SEQ ID NO: 118178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attgcaaaactacttttcac

SEQ ID NO: 118179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaaactacttttcactcag

SEQ ID NO: 118180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttttcactcagttttactt

SEQ ID NO: 118181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcactcagttttactttct

SEQ ID NO: 118182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcactcagttttactttctc

SEQ ID NO: 118183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cactcagttttactttctca

SEQ ID NO: 118184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actcagttttactttctcaa

SEQ ID NO: 118185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agttttactttctcaactac

SEQ ID NO: 118186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tactttctcaactactacta

SEQ ID NO: 118187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actttctcaactactactac

SEQ ID NO: 118188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttctcaactactactact

SEQ ID NO: 118189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctcaactactactactgat

SEQ ID NO: 118190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcaactactactactgatt

SEQ ID NO: 118191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaactactactactgattc

SEQ ID NO: 118192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aactactactactgattctt

SEQ ID NO: 118193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctactactgattcttggttt

SEQ ID NO: 118194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctactgattcttggtttttg

SEQ ID NO: 118195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgattcttggtttttgaat

SEQ ID NO: 118196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attcttggtttttgaatttt

SEQ ID NO: 118197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttggtttttgaattttttaa

SEQ ID NO: 118198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtttttgaattttttaaaa

SEQ ID NO: 118199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtttttgaattttttaaaaa

SEQ ID NO: 118200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgaattttttaaaaatcag

SEQ ID NO: 118201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaattttttaaaaatcagg

SEQ ID NO: 118202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaattttttaaaaatcaggc

SEQ ID NO: 118203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattttttaaaaatcaggct

SEQ ID NO: 118204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaaaatcaggcttctaa

SEQ ID NO: 118205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaaatcaggcttctaat

SEQ ID NO: 118206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaatcaggcttctaatc

SEQ ID NO: 118207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaatcaggcttctaatcg

SEQ ID NO: 118208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatcaggcttctaatcgt

SEQ ID NO: 118209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaatcgttaagacttagtc

SEQ ID NO: 118210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taatcgttaagacttagtcc

SEQ ID NO: 118211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atcgttaagacttagtcctc

SEQ ID NO: 118212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agacttagtcctctaatcat

SEQ ID NO: 118213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtcctctaatcatatcaca

SEQ ID NO: 118214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtcctctaatcatatcacaa

SEQ ID NO: 118215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taatcatatcacaacgtttt

SEQ ID NO: 118216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atcatatcacaacgttttct

SEQ ID NO: 118217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttctttctctttctttt

SEQ ID NO: 118218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctctttcttttt

SEQ ID NO: 118219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctctttctttttt

SEQ ID NO: 118220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctctttctttttttc

SEQ ID NO: 118221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctctttctttttttct

SEQ ID NO: 118222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctctttctttttttctt

SEQ ID NO: 118223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctctttctttttttctttc

SEQ ID NO: 118224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctttctttttttctttct

SEQ ID NO: 118225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctttctttttttctttctt

SEQ ID NO: 118226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttctttttttctttctttc

SEQ ID NO: 118227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttttttctttctttctt

SEQ ID NO: 118228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttttttctttctttcttt

SEQ ID NO: 118229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttttctttctttctttc

SEQ ID NO: 118230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttctttctttctttctt

SEQ ID NO: 118231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttctttctttctttcttt

SEQ ID NO: 118232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctttctttctttctttt

SEQ ID NO: 118233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctttctttctttcttttc

SEQ ID NO: 118234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttctttctttcttttcc

SEQ ID NO: 118235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttcttttcct

SEQ ID NO: 118236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttcttttcctt

SEQ ID NO: 118237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttcttttccttcc

SEQ ID NO: 118238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttcttttccttcct

SEQ ID NO: 118239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttcttttccttcctt

SEQ ID NO: 118240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttcttttccttccttcc

SEQ ID NO: 118241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcttttccttccttccc

SEQ ID NO: 118242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcttttccttccttccct

SEQ ID NO: 118243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttttccttccttccctct

SEQ ID NO: 118244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttccttccttccctctc

SEQ ID NO: 118245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttccttccttccctctct

SEQ ID NO: 118246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttccttccttccctctctcc

SEQ ID NO: 118247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccttccttccctctctcct

SEQ ID NO: 118248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttccttccctctctcctt

SEQ ID NO: 118249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttccttccctctctccttt

SEQ ID NO: 118250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttccctctctcctttctt

SEQ ID NO: 118251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttccctctctcctttcttt

SEQ ID NO: 118252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctctctcctttcttttct

SEQ ID NO: 118253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctctctcctttcttttctt

SEQ ID NO: 118254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctcctttcttttctttccc

SEQ ID NO: 118255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcctttcttttctttccctt

SEQ ID NO: 118256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctttcttttctttccctttc

SEQ ID NO: 118257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttttctttccctttcttt

SEQ ID NO: 118258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttctttccctttctttc

SEQ ID NO: 118259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttctttccctttctttct

SEQ ID NO: 118260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctttccctttctttcttt

SEQ ID NO: 118261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttccctttctttctttc

SEQ ID NO: 118262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttccctttctttctttct

SEQ ID NO: 118263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttccctttctttctttctt

SEQ ID NO: 118264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccctttctttctttctttc

SEQ ID NO: 118265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctttctttctttctttct

SEQ ID NO: 118266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctttctttctttctttctt

SEQ ID NO: 118267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttctttctttctt

SEQ ID NO: 118268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttctttcttt

SEQ ID NO: 118269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttctttctttc

SEQ ID NO: 118270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttctttctttctt

SEQ ID NO: 118271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttctttcttt

SEQ ID NO: 118272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttctttctttc

SEQ ID NO: 118273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttctttctttctt

SEQ ID NO: 118274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttctttcttt

SEQ ID NO: 118275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttctttctttc

SEQ ID NO: 118276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttctttctttctt

SEQ ID NO: 118277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttctttcttt

SEQ ID NO: 118278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttctttctttc

SEQ ID NO: 118279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttctttctttctt

SEQ ID NO: 118280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttctttcttt

SEQ ID NO: 118281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttctttctttc

SEQ ID NO: 118282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttctttctttctt

SEQ ID NO: 118283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttctttcttt

SEQ ID NO: 118284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttctttctttc

SEQ ID NO: 118285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttctttctttctt

SEQ ID NO: 118286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttctttcttt

SEQ ID NO: 118287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttctttctttc

SEQ ID NO: 118288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttctttctttctt

SEQ ID NO: 118289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttctttcttt

SEQ ID NO: 118290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttctttctttc

SEQ ID NO: 118291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttctttctttctt

SEQ ID NO: 118292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttctttcttt

SEQ ID NO: 118293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttctttctttc

SEQ ID NO: 118294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttctttctttctt

SEQ ID NO: 118295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttctttcttt

SEQ ID NO: 118296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttctttctttc

SEQ ID NO: 118297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttctttctttctt

SEQ ID NO: 118298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttctttcttt

SEQ ID NO: 118299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttctttctttt

SEQ ID NO: 118300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttctttctttttc

SEQ ID NO: 118301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttctttttct

SEQ ID NO: 118302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttctttttctt

SEQ ID NO: 118303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttctttttctttc

SEQ ID NO: 118304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttttctttct

SEQ ID NO: 118305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttttctttctt

SEQ ID NO: 118306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttttctttctttc

SEQ ID NO: 118307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttttctttctttct

SEQ ID NO: 118308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttttctttctttctt

SEQ ID NO: 118309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttttctttctttctttc

SEQ ID NO: 118310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttttctttctttctttcc

SEQ ID NO: 118311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttctttctttctttcct

SEQ ID NO: 118312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttctttctttctttccttt

SEQ ID NO: 118313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctttctttctttcctttc

SEQ ID NO: 118314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttctttctttcctttct

SEQ ID NO: 118315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttctttcctttctc

SEQ ID NO: 118316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttctttcctttctct

SEQ ID NO: 118317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttctttcctttctcttc

SEQ ID NO: 118318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttctttcctttctcttct

SEQ ID NO: 118319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctttcctttctcttctt

SEQ ID NO: 118320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttcctttctcttctttc

SEQ ID NO: 118321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcctttctcttctttct

SEQ ID NO: 118322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcctttctcttctttctt

SEQ ID NO: 118323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcctttctcttctttctttt

SEQ ID NO: 118324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctttctcttctttcttttt

SEQ ID NO: 118325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttctcttctttctttttt

SEQ ID NO: 118326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctcttctttcttttttgat

SEQ ID NO: 118327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcttctttcttttttgata

SEQ ID NO: 118328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttctttcttttttgatag

SEQ ID NO: 118329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttctttcttttttgatagtg

SEQ ID NO: 118330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttcttttttgatagtgta

SEQ ID NO: 118331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcttttttgatagtgtat

SEQ ID NO: 118332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttttttgatagtgtattt

SEQ ID NO: 118333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttttgatagtgtatttc

SEQ ID NO: 118334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttttgatagtgtatttct

SEQ ID NO: 118335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttgatagtgtatttctgt

SEQ ID NO: 118336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgatagtgtatttctgtg

SEQ ID NO: 118337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgatagtgtatttctgtgt

SEQ ID NO: 118338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgatagtgtatttctgtgtc

SEQ ID NO: 118339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatagtgtatttctgtgtca

SEQ ID NO: 118340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atagtgtatttctgtgtcac

SEQ ID NO: 118341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtgtcacccaggctgtag

SEQ ID NO: 118342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtgtcacccaggctgtagt

SEQ ID NO: 118343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtcacccaggctgtagtgc

SEQ ID NO: 118344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagtgcagtagtgcattgac

SEQ ID NO: 118345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acagctcactgcagcctcca

SEQ ID NO: 118346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actgcagcctccacctctgg

SEQ ID NO: 118347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagcctccacctctgggatt

SEQ ID NO: 118348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cacctctgggattcaagtga

SEQ ID NO: 118349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgggattcaagtgaccctcc

SEQ ID NO: 118350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggattcaagtgaccctccca

SEQ ID NO: 118351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagtgaccctcccacctcag

SEQ ID NO: 118352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccacctcagcctctcaagta

SEQ ID NO: 118353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcctctcaagtagctagga

SEQ ID NO: 118354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaagtagctaggactgcag

SEQ ID NO: 118355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagtagctaggactgcaggc

SEQ ID NO: 118356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggactgcaggcaggcgccac

SEQ ID NO: 118357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caggcaggcgccacaacacc

SEQ ID NO: 118358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agttttgtctattttttata

SEQ ID NO: 118359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtctattttttatagaaat

SEQ ID NO: 118360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtctattttttatagaaatg

SEQ ID NO: 118361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctattttttatagaaatgg

SEQ ID NO: 118362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttttatagaaatggggtc

SEQ ID NO: 118363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttatagaaatggggtctta

SEQ ID NO: 118364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatagaaatggggtcttac

SEQ ID NO: 118365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatagaaatggggtcttact

SEQ ID NO: 118366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagaaatggggtcttacta

SEQ ID NO: 118367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagaaatggggtcttactat

SEQ ID NO: 118368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actatgttgccccggctggt

SEQ ID NO: 118369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctatgttgccccggctggtc

SEQ ID NO: 118370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgttgccccggctggtcttg

SEQ ID NO: 118371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccccggctggtcttgaactc

SEQ ID NO: 118372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtcttgaactcctgggctca

SEQ ID NO: 118373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaactcctgggctcaagtga

SEQ ID NO: 118374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aactcctgggctcaagtgat

SEQ ID NO: 118375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgggctcaagtgatccacc

SEQ ID NO: 118376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggctcaagtgatccacccac

SEQ ID NO: 118377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagtgatccacccacctcag

SEQ ID NO: 118378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcctcccaaagtgctggga

SEQ ID NO: 118379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaaagtgctgggattgcag

SEQ ID NO: 118380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggattgcaggcatgagccgt

SEQ ID NO: 118381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caggcatgagccgtcctgcc

SEQ ID NO: 118382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctggctttgaagtttattt

SEQ ID NO: 118383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctttgaagtttatttcttc

SEQ ID NO: 118384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaagtttatttcttcatgt

SEQ ID NO: 118385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaagtttatttcttcatgta

SEQ ID NO: 118386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagtttatttcttcatgtac

SEQ ID NO: 118387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttcttcatgtacaaatat

SEQ ID NO: 118388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcttcatgtacaaatata

SEQ ID NO: 118389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcatgtacaaatatatgc

SEQ ID NO: 118390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcatgtacaaatatatgcc

SEQ ID NO: 118391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catgtacaaatatatgccaa

SEQ ID NO: 118392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtacaaatatatgccaag

SEQ ID NO: 118393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtatttattctatatttta

SEQ ID NO: 118394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attctatattttatttttat

SEQ ID NO: 118395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctatattttatttttata

SEQ ID NO: 118396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatattttatttttataact

SEQ ID NO: 118397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tattttatttttataactgc

SEQ ID NO: 118398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttttataactgcatttc

SEQ ID NO: 118399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttttataactgcatttct

SEQ ID NO: 118400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttataactgcatttctt

SEQ ID NO: 118401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttataactgcatttctttgt

SEQ ID NO: 118402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tataactgcatttctttgta

SEQ ID NO: 118403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataactgcatttctttgtat

SEQ ID NO: 118404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taactgcatttctttgtatt

SEQ ID NO: 118405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catttctttgtattattatg

SEQ ID NO: 118406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttgtattattatgtgcat

SEQ ID NO: 118407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttgtattattatgtgcatt

SEQ ID NO: 118408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtattattatgtgcattga

SEQ ID NO: 118409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtattattatgtgcattgat

SEQ ID NO: 118410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattattatgtgcattgata

SEQ ID NO: 118411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatgtgcattgatatacta

SEQ ID NO: 118412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtgcattgatatactaaag

SEQ ID NO: 118413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atatactaaagtattttcta

SEQ ID NO: 118414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtattttctaaagaacta

SEQ ID NO: 118415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctaaagaactatttccttt

SEQ ID NO: 118416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaaagaactatttcctttg

SEQ ID NO: 118417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaagaactatttcctttgg

SEQ ID NO: 118418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagaactatttcctttggaa

SEQ ID NO: 118419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttcctttggaaatatctct

SEQ ID NO: 118420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctttggaaatatctcttaa

SEQ ID NO: 118421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttggaaatatctcttaat

SEQ ID NO: 118422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggaaatatctcttaattga

SEQ ID NO: 118423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaaatatctcttaattgac

SEQ ID NO: 118424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaatatctcttaattgacc

SEQ ID NO: 118425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaattgaccttaccttttt

SEQ ID NO: 118426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aattgaccttacctttttag

SEQ ID NO: 118427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attgaccttacctttttaga

SEQ ID NO: 118428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
accttacctttttagaagaa

SEQ ID NO: 118429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acctttttagaagaaaagtt

SEQ ID NO: 118430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctttttagaagaaaagttg

SEQ ID NO: 118431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttagaagaaaagttgaaaa

SEQ ID NO: 118432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagaagaaaagttgaaaac

SEQ ID NO: 118433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagaagaaaagttgaaaact

SEQ ID NO: 118434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaagaaaagttgaaaactg

SEQ ID NO: 118435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaagaaaagttgaaaactgg

SEQ ID NO: 118436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaactgggctggggaacaa

SEQ ID NO: 118437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggctggggaacaaatggaaa

SEQ ID NO: 118438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gggaacaaatggaaaataag

SEQ ID NO: 118439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaactatcatgtatgtaat

SEQ ID NO: 118440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taactatcatgtatgtaata

SEQ ID NO: 118441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactatcatgtatgtaatag

SEQ ID NO: 118442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actatcatgtatgtaataga

SEQ ID NO: 118443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcatgtatgtaatagagtga

SEQ ID NO: 118444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcaagcaaatggaaatttc

SEQ ID NO: 118445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaagcaaatggaaatttca

SEQ ID NO: 118446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacattcaagaataacttag

SEQ ID NO: 118447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acattcaagaataacttaga

SEQ ID NO: 118448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagaataacttagacatatc

SEQ ID NO: 118449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agacatatctatataatgac

SEQ ID NO: 118450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gacatatctatataatgaca

SEQ ID NO: 118451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tataatgacatggtgagtta

SEQ ID NO: 118452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cactggtttataattttcac

SEQ ID NO: 118453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtttataattttcacagctc

SEQ ID NO: 118454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataattttcacagctctttc

SEQ ID NO: 118455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taattttcacagctctttca

SEQ ID NO: 118456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcacagctctttcacatata

SEQ ID NO: 118457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacagctctttcacatatag

SEQ ID NO: 118458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acagctctttcacatatagc

SEQ ID NO: 118459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttcacatatagcaatgctc

SEQ ID NO: 118460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcacatatagcaatgctcta

SEQ ID NO: 118461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacatatagcaatgctctaa

SEQ ID NO: 118462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acatatagcaatgctctaaa

SEQ ID NO: 118463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taaaatataaactgcaaaga

SEQ ID NO: 118464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatataaactgcaaagatt

SEQ ID NO: 118465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caaagattcctttcattttt

SEQ ID NO: 118466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttcatttttcttaccaaa

SEQ ID NO: 118467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcatttttcttaccaaaggt

SEQ ID NO: 118468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catttttcttaccaaaggtg

SEQ ID NO: 118469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttttcttaccaaaggtga

SEQ ID NO: 118470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttaccaaaggtgacatt

SEQ ID NO: 118471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttaccaaaggtgacattg

SEQ ID NO: 118472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttaccaaaggtgacattga

SEQ ID NO: 118473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaccaaaggtgacattgag

SEQ ID NO: 118474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
accaaaggtgacattgagat

SEQ ID NO: 118475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccaaaggtgacattgagatt

SEQ ID NO: 118476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agatttacaaagtttggtgc

SEQ ID NO: 118477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaaagtttggtgcttgtta

SEQ ID NO: 118478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaagtttggtgcttgttac

SEQ ID NO: 118479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtgcttgttaccaagtcat

SEQ ID NO: 118480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgcttgttaccaagtcatg

SEQ ID NO: 118481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttaccaagtcatgtttaag

SEQ ID NO: 118482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaccaagtcatgtttaagg

SEQ ID NO: 118483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccaagtcatgtttaaggaaa

SEQ ID NO: 118484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaggaaacattgaagctatg

SEQ ID NO: 118485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggaaacattgaagctatga

SEQ ID NO: 118486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagctatgaccagaagtcag

SEQ ID NO: 118487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgaccagaagtcaggctttg

SEQ ID NO: 118488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgagctttgagttcagtggc

SEQ ID NO: 118489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagctttgagttcagtggct

SEQ ID NO: 118490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agctttgagttcagtggctt

SEQ ID NO: 118491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgagttcagtggcttctccc

SEQ ID NO: 118492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagttcagtggcttctccca

SEQ ID NO: 118493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agttcagtggcttctcccac

SEQ ID NO: 118494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtggcttctcccactttat

SEQ ID NO: 118495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcccactttataccgtcta

SEQ ID NO: 118496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcccactttataccgtctaa

SEQ ID NO: 118497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccactttataccgtctaaga

SEQ ID NO: 118498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tataccgtctaagaaaagtt

SEQ ID NO: 118499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataccgtctaagaaaagtta

SEQ ID NO: 118500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taccgtctaagaaaagttaa

SEQ ID NO: 118501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaaaagttaatttgataga

SEQ ID NO: 118502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttgatagaagacaatgaa

SEQ ID NO: 118503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatagaagacaatgaaagaa

SEQ ID NO: 118504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atagaagacaatgaaagaat

SEQ ID NO: 118505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcaacaatagacctgcagat

SEQ ID NO: 118506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagatgttttaaaaggcact

SEQ ID NO: 118507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaggcactagtttagcc

SEQ ID NO: 118508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaggcactagtttagcca

SEQ ID NO: 118509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaggcactagtttagccaa

SEQ ID NO: 118510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtttagccaatatgcctaaa

SEQ ID NO: 118511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agccaatatgcctaaatatg

SEQ ID NO: 118512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccaatatgcctaaatatgt

SEQ ID NO: 118513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatatgtacatgggtctctt

SEQ ID NO: 118514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttaagactccacaaagaga

SEQ ID NO: 118515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taagactccacaaagagaca

SEQ ID NO: 118516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagactccacaaagagacac

SEQ ID NO: 118517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agactccacaaagagacact

SEQ ID NO: 118518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cacaaagagacactgctaag

SEQ ID NO: 118519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctaagagttactggaaacaa

SEQ ID NO: 118520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agagttactggaaacaaact

SEQ ID NO: 118521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctggaaacaaactacagctg

SEQ ID NO: 118522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaacaaactacagctgctc

SEQ ID NO: 118523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagctgctctgtgaataaat

SEQ ID NO: 118524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctctgtgaataaattcttag

SEQ ID NO: 118525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtgaataaattcttagttc

SEQ ID NO: 118526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgaataaattcttagttcac

SEQ ID NO: 118527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttagttcacagttgctgtgg

SEQ ID NO: 118528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agttcacagttgctgtggga

SEQ ID NO: 118529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttcacagttgctgtgggaa

SEQ ID NO: 118530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acagttgctgtgggaaaaaa

SEQ ID NO: 118531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgtgggaaaaaatgaaaga

SEQ ID NO: 118532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgggaaaaaatgaaagatcc

SEQ ID NO: 118533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaagtctgggagatttcct

SEQ ID NO: 118534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggagatttcctataattagt

SEQ ID NO: 118535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctataattagttgctatta

SEQ ID NO: 118536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctataattagttgctattat

SEQ ID NO: 118537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taattagttgctattatatt

SEQ ID NO: 118538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttgctattatattactttt

SEQ ID NO: 118539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctattatattacttttgcta

SEQ ID NO: 118540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttatattacttttgctatga

SEQ ID NO: 118541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattacttttgctatgacac

SEQ ID NO: 118542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttttgctatgacacagtac

SEQ ID NO: 118543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgctatgacacagtacaga

SEQ ID NO: 118544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctatgacacagtacagaa

SEQ ID NO: 118545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctatgacacagtacagaag

SEQ ID NO: 118546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctatgacacagtacagaaga

SEQ ID NO: 118547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgacacagtacagaagaaag

SEQ ID NO: 118548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgtttcatttctttattat

SEQ ID NO: 118549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttcatttctttattatttt

SEQ ID NO: 118550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catttctttattattttctt

SEQ ID NO: 118551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttctttattattttctta

SEQ ID NO: 118552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttattattttcttaattg

SEQ ID NO: 118553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttattattttcttaattgc

SEQ ID NO: 118554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattattttcttaattgctt

SEQ ID NO: 118555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attattttcttaattgcttt

SEQ ID NO: 118556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattttcttaattgctttt

SEQ ID NO: 118557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcttaattgctttttta

SEQ ID NO: 118558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttaattgcttttttacta

SEQ ID NO: 118559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttaattgcttttttactaa

SEQ ID NO: 118560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaattgcttttttactaac

SEQ ID NO: 118561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aattgcttttttactaacag

SEQ ID NO: 118562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attgcttttttactaacagc

SEQ ID NO: 118563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttttttactaacagcctgt

SEQ ID NO: 118564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttactaacagcctgtgtc

SEQ ID NO: 118565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttactaacagcctgtgtct

SEQ ID NO: 118566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttactaacagcctgtgtctc

SEQ ID NO: 118567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tactaacagcctgtgtctca

SEQ ID NO: 118568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actaacagcctgtgtctcaa

SEQ ID NO: 118569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaacagcctgtgtctcaag

SEQ ID NO: 118570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acagcctgtgtctcaaggaa

SEQ ID NO: 118571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtctcaaggaagccaagcc

SEQ ID NO: 118572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaggaagccaagccatattc

SEQ ID NO: 118573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttcatcaataacattaat

SEQ ID NO: 118574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catcaataacattaatctgt

SEQ ID NO: 118575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcaataacattaatctgtc

SEQ ID NO: 118576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atctgtcatttcattcagga

SEQ ID NO: 118577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcatttcattcaggaaatac

SEQ ID NO: 118578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattcaggaaatacaagaaa

SEQ ID NO: 118579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attcaggaaatacaagaaag

SEQ ID NO: 118580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggaaatacaagaaaggttt

SEQ ID NO: 118581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cggttttaaccttaagaata

SEQ ID NO: 118582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ggttttaaccttaagaatac

SEQ ID NO: 118583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaccttaagaatactagga

SEQ ID NO: 118584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaccttaagaatactaggat

SEQ ID NO: 118585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
accttaagaatactaggata

SEQ ID NO: 118586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagaatactaggatattctg

SEQ ID NO: 118587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaatactaggatattctga

SEQ ID NO: 118588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggatattctgatctctctta

SEQ ID NO: 118589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgatctctcttatattgttt

SEQ ID NO: 118590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atctctcttatattgttttg

SEQ ID NO: 118591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcttatattgttttgtaagc

SEQ ID NO: 118592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttatattgttttgtaagcat

SEQ ID NO: 118593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atattgttttgtaagcatac

SEQ ID NO: 118594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattgttttgtaagcatact

SEQ ID NO: 118595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttgtaagcatacttgcag

SEQ ID NO: 118596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaagcatacttgcagaat

SEQ ID NO: 118597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaagcatacttgcagaata

SEQ ID NO: 118598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagcatacttgcagaataa

SEQ ID NO: 118599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcagaataatgtcaatacat

SEQ ID NO: 118600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagaataatgtcaatacata

SEQ ID NO: 118601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagacttgtgtttctgcatg

SEQ ID NO: 118602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgtttctgcatgtgtggca

SEQ ID NO: 118603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtttctgcatgtgtggcat

SEQ ID NO: 118604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgcatgtgtggcataaatg

SEQ ID NO: 118605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcatgtgtggcataaatgt

SEQ ID NO: 118606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catgtgtggcataaatgttt

SEQ ID NO: 118607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcaaaataataactatgtg

SEQ ID NO: 118608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaaaataataactatgtga

SEQ ID NO: 118609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtgattattatgtatacta

SEQ ID NO: 118610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatgtatactatgttgttc

SEQ ID NO: 118611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtatactatgttgttccca

SEQ ID NO: 118612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgttgttcccaagtcttgtc

SEQ ID NO: 118613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttcccaagtcttgtcctgat

SEQ ID NO: 118614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaagtcttgtcctgattat

SEQ ID NO: 118615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtcctgattatattatacct

SEQ ID NO: 118616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcctgattatattatacctt

SEQ ID NO: 118617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attatattataccttatatt

SEQ ID NO: 118618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattataccttatatttgag

SEQ ID NO: 118619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taccttatatttgagaaatt

SEQ ID NO: 118620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atatttgagaaattatgatg

SEQ ID NO: 118621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatttgagaaattatgatgc

SEQ ID NO: 118622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagaaattatgatgccctat

SEQ ID NO: 118623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaaattatgatgccctata

SEQ ID NO: 118624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgatgccctataaatagaga

SEQ ID NO: 118625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaatagagaaaagcgcaca

SEQ ID NO: 118626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tataatactaataatatatt

SEQ ID NO: 118627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ataatatattgcatttactt

SEQ ID NO: 118628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catttactttaaaatcgttt

SEQ ID NO: 118629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actttaaaatcgtttagaat

SEQ ID NO: 118630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttaaaatcgtttagaatc

SEQ ID NO: 118631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaaatcgtttagaatcttt

SEQ ID NO: 118632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatcgtttagaatctttg

SEQ ID NO: 118633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatcgtttagaatctttgg

SEQ ID NO: 118634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaatctttgggctatttaa

SEQ ID NO: 118635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatctttgggctatttaaa

SEQ ID NO: 118636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgggctatttaaagtttgta

SEQ ID NO: 118637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggctatttaaagtttgtac

SEQ ID NO: 118638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggctatttaaagtttgtaca

SEQ ID NO: 118639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttaaagtttgtacaaaaaa

SEQ ID NO: 118640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagtttgtacaaaaaacac

SEQ ID NO: 118641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtttgtacaaaaaacaca

SEQ ID NO: 118642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtacaaaaaacacaaatgac

SEQ ID NO: 118643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tacaaaaaacacaaatgact

SEQ ID NO: 118644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caatcagtaatagaaccaat

SEQ ID NO: 118645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatcagtaatagaaccaatc

SEQ ID NO: 118646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtcaatgaatgccatatgga

SEQ ID NO: 118647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttggtcactttttgacact

SEQ ID NO: 118648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtcactttttgacactgca

SEQ ID NO: 118649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtcactttttgacactgcag

SEQ ID NO: 118650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttgacactgcaggccagtc

SEQ ID NO: 118651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgacactgcaggccagtca

SEQ ID NO: 118652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgacactgcaggccagtcat

SEQ ID NO: 118653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacactgcaggccagtcatg

SEQ ID NO: 118654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acactgcaggccagtcatga

SEQ ID NO: 118655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caggccagtcatgacccctt

SEQ ID NO: 118656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caatgtgccaatggtcaact

SEQ ID NO: 118657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgtgccaatggtcaacta

SEQ ID NO: 118658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgcagttagctttcctgcc

SEQ ID NO: 118659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagttagctttcctgccttt

SEQ ID NO: 118660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctttcctgcctttccttaa

SEQ ID NO: 118661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcctgcctttccttaaggtg

SEQ ID NO: 118662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgcctttccttaaggtga

SEQ ID NO: 118663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgcctttccttaaggtgat

SEQ ID NO: 118664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctttccttaaggtgataat

SEQ ID NO: 118665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccttaaggtgataatatct

SEQ ID NO: 118666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttaaggtgataatatcta

SEQ ID NO: 118667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttaaggtgataatatctat

SEQ ID NO: 118668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaggtgataatatctatagg

SEQ ID NO: 118669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggtgataatatctatagga

SEQ ID NO: 118670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taggaccaagttttccatcc

SEQ ID NO: 118671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccatccttataattaagtg

SEQ ID NO: 118672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccatccttataattaagtgt

SEQ ID NO: 118673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catccttataattaagtgtt

SEQ ID NO: 118674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataattaagtgttacaaaca

SEQ ID NO: 118675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taattaagtgttacaaacat

SEQ ID NO: 118676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtgttacaaacattatggc

SEQ ID NO: 118677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaacattatggctttaatt

SEQ ID NO: 118678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggctttaattatagtgtgg

SEQ ID NO: 118679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taattatagtgtggcttaaa

SEQ ID NO: 118680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattatagtgtggcttaaac

SEQ ID NO: 118681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attatagtgtggcttaaact

SEQ ID NO: 118682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagtgtggcttaaactgttt

SEQ ID NO: 118683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaactgttttttaaagatta

SEQ ID NO: 118684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aactgttttttaaagattaa

SEQ ID NO: 118685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttttaaagattaaaccat

SEQ ID NO: 118686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaagattaaaccattag

SEQ ID NO: 118687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaagattaaaccattaga

SEQ ID NO: 118688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaagattaaaccattagag

SEQ ID NO: 118689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagattaaaccattagagt

SEQ ID NO: 118690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagattaaaccattagagtc

SEQ ID NO: 118691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaccattagagtcagagaaa

SEQ ID NO: 118692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagtcagagaaaattttcta

SEQ ID NO: 118693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctacctcacgtttagaata

SEQ ID NO: 118694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctacctcacgtttagaatag

SEQ ID NO: 118695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacctcacgtttagaataga

SEQ ID NO: 118696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctcacgtttagaatagagt

SEQ ID NO: 118697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acgtttagaatagagtctcc

SEQ ID NO: 118698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaatagagtctccaattat

SEQ ID NO: 118699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatagagtctccaattatt

SEQ ID NO: 118700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caattatttttgatcatcac

SEQ ID NO: 118701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttgatcatcacccttac

SEQ ID NO: 118702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgatcatcacccttaccag

SEQ ID NO: 118703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgatcatcacccttaccagc

SEQ ID NO: 118704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatcatcacccttaccagct

SEQ ID NO: 118705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcatcacccttaccagctc

SEQ ID NO: 118706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
accagctcaataatagcaat

SEQ ID NO: 118707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccagctcaataatagcaata

SEQ ID NO: 118708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aataatagcaataccaataa

SEQ ID NO: 118709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaataaatgaatttatatg

SEQ ID NO: 118710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatgcttgctaaattataa

SEQ ID NO: 118711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatgcttgctaaattataaa

SEQ ID NO: 118712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctaaattataaacaatcta

SEQ ID NO: 118713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctaaattataaacaatctac

SEQ ID NO: 118714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattataaacaatctacaca

SEQ ID NO: 118715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaacaatctacacatgcag

SEQ ID NO: 118716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacatgcagtgtaaaacata

SEQ ID NO: 118717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaatatacacaaaattga

SEQ ID NO: 118718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatatacacaaaattgaa

SEQ ID NO: 118719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaactattttttattttatc

SEQ ID NO: 118720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttttattttatcattatt

SEQ ID NO: 118721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttattttatcattattttt

SEQ ID NO: 118722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattttatcattatttttt

SEQ ID NO: 118723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttatcattatttttta

SEQ ID NO: 118724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttatcattattttttaa

SEQ ID NO: 118725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttatcattattttttaaa

SEQ ID NO: 118726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcattattttttaaatct

SEQ ID NO: 118727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcattattttttaaatcta

SEQ ID NO: 118728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcattattttttaaatctat

SEQ ID NO: 118729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttttaaatctatcattac

SEQ ID NO: 118730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaatctatcattacctt

SEQ ID NO: 118731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaatctatcattaccttg

SEQ ID NO: 118732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaatctatcattaccttga

SEQ ID NO: 118733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatctatcattaccttgat

SEQ ID NO: 118734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatctatcattaccttgatc

SEQ ID NO: 118735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcattaccttgatcttgaat

SEQ ID NO: 118736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccttgatcttgaataaaatt

SEQ ID NO: 118737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatcttgaataaaattgaaa

SEQ ID NO: 118738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcttgaataaaattgaaac

SEQ ID NO: 118739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaataaaattgaaactttta

SEQ ID NO: 118740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aataaaattgaaacttttaa

SEQ ID NO: 118741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaacttttaaagataagaat

SEQ ID NO: 118742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaagataagaatgaagac

SEQ ID NO: 118743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaagataagaatgaagaca

SEQ ID NO: 118744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagataagaatgaagacaa

SEQ ID NO: 118745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagataagaatgaagacaaa

SEQ ID NO: 118746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttccagcattgttcttaggt

SEQ ID NO: 118747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccagcattgttcttaggtgt

SEQ ID NO: 118748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagcattgttcttaggtgtg

SEQ ID NO: 118749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttcttaggtgtgcatattca

SEQ ID NO: 118750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaggtgtgcatattcaact

SEQ ID NO: 118751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aggtgtgcatattcaacttt

SEQ ID NO: 118752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtgtgcatattcaactttg

SEQ ID NO: 118753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aactttggaaaccacagatt

SEQ ID NO: 118754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggaaaccacagattatgcc

SEQ ID NO: 118755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaaaccacagattatgccc

SEQ ID NO: 118756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaaccacagattatgccct

SEQ ID NO: 118757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgccctttgcatacatccac

SEQ ID NO: 118758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcatacatccaccaccaaa

SEQ ID NO: 118759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcatacatccaccaccaaag

SEQ ID NO: 118760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catacatccaccaccaaagc

SEQ ID NO: 118761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctggagaactcaggcaaa

SEQ ID NO: 118762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctggagaactcaggcaaac

SEQ ID NO: 118763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagaactcaggcaaacatgt

SEQ ID NO: 118764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggcaaacatgtccctgtcc

SEQ ID NO: 118765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tccatccctaccttcatgct

SEQ ID NO: 118766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccttcatgctgcaaaaacgt

SEQ ID NO: 118767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catgctgcaaaaacgttttt

SEQ ID NO: 118768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgctgcaaaaacgttttta

SEQ ID NO: 118769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caaaaacgtttttagcacat

SEQ ID NO: 118770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagcacatagagtgcattg

SEQ ID NO: 118771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagcacatagagtgcattga

SEQ ID NO: 118772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcacatagagtgcattgag

SEQ ID NO: 118773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcacatagagtgcattgagt

SEQ ID NO: 118774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agttttaaaactagcattct

SEQ ID NO: 118775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaactagcattctttcaa

SEQ ID NO: 118776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaactagcattctttcaac

SEQ ID NO: 118777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaactagcattctttcaaca

SEQ ID NO: 118778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcattctttcaacatcagat

SEQ ID NO: 118779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcaacatcagattaattg

SEQ ID NO: 118780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaacatcagattaattgaa

SEQ ID NO: 118781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caacatcagattaattgaaa

SEQ ID NO: 118782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacatcagattaattgaaat

SEQ ID NO: 118783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attgaaatgtcttctcttgc

SEQ ID NO: 118784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatgtcttctcttgcataa

SEQ ID NO: 118785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcttgcataacatctttct

SEQ ID NO: 118786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttgcataacatctttcta

SEQ ID NO: 118787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgcataacatctttctaga

SEQ ID NO: 118788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcataacatctttctagagc

SEQ ID NO: 118789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cataacatctttctagagcc

SEQ ID NO: 118790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctagagcctgtaaaattaa

SEQ ID NO: 118791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctagagcctgtaaaattaac

SEQ ID NO: 118792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagagcctgtaaaattaact

SEQ ID NO: 118793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gagcctgtaaaattaactaa

SEQ ID NO: 118794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaaattaactaaataatgt

SEQ ID NO: 118795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actaaataatgtagtgcagg

SEQ ID NO: 118796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aataatgtagtgcaggtaaa

SEQ ID NO: 118797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attcatatgaaataattaca

SEQ ID NO: 118798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcatatgaaataattacac

SEQ ID NO: 118799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatgaaataattacactaa

SEQ ID NO: 118800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cactaattttcttggtgagg

SEQ ID NO: 118801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attttcttggtgaggtgaaa

SEQ ID NO: 118802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttggtgaggtgaaaaaag

SEQ ID NO: 118803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttggtgaggtgaaaaaaga

SEQ ID NO: 118804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttggtgaggtgaaaaaagag

SEQ ID NO: 118805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtgaggtgaaaaaagagca

SEQ ID NO: 118806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgaggtgaaaaaagagcac

SEQ ID NO: 118807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttgtcatatactttgctt

SEQ ID NO: 118808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgtcatatactttgcttg

SEQ ID NO: 118809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtcatatactttgcttgt

SEQ ID NO: 118810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtcatatactttgcttgtt

SEQ ID NO: 118811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcatatactttgcttgttt

SEQ ID NO: 118812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcatatactttgcttgtttt

SEQ ID NO: 118813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcttgttttataggaaaaa

SEQ ID NO: 118814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttgttttataggaaaaaa

SEQ ID NO: 118815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttgttttataggaaaaaaa

SEQ ID NO: 118816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttttataggaaaaaaatta

SEQ ID NO: 118817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttataggaaaaaaattat

SEQ ID NO: 118818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tataggaaaaaaattataga

SEQ ID NO: 118819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataggaaaaaaattatagat

SEQ ID NO: 118820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taggaaaaaaattatagatt

SEQ ID NO: 118821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagatttgtgataacctatt

SEQ ID NO: 118822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgataacctatttagaatt

SEQ ID NO: 118823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgataacctatttagaattc

SEQ ID NO: 118824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttagaattctaatcaatgt

SEQ ID NO: 118825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaattctaatcaatgtttt

SEQ ID NO: 118826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaattctaatcaatgtttta

SEQ ID NO: 118827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taatcaatgttttatttcaa

SEQ ID NO: 118828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atcaatgttttatttcaaaa

SEQ ID NO: 118829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttcaaaaagaaaacaga

SEQ ID NO: 118830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttcaaaaagaaaacagaa

SEQ ID NO: 118831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcaaaaagaaaacagaag

SEQ ID NO: 118832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaaagaaaacagaagtaa

SEQ ID NO: 118833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaagaaaacagaagtaaa

SEQ ID NO: 118834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacatataaaaacccaaagc

SEQ ID NO: 118835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acatataaaaacccaaagct

SEQ ID NO: 118836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaggagactttacatatgt

SEQ ID NO: 118837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taggagactttacatatgtt

SEQ ID NO: 118838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggagactttacatatgttg

SEQ ID NO: 118839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggagactttacatatgttga

SEQ ID NO: 118840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacatatgttgatattttat

SEQ ID NO: 118841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatatgttgatattttata

SEQ ID NO: 118842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catatgttgatattttatag

SEQ ID NO: 118843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atattttatagaactaggaa

SEQ ID NO: 118844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatagaactaggaatgcttg

SEQ ID NO: 118845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagaactaggaatgcttgt

SEQ ID NO: 118846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagaactaggaatgcttgta

SEQ ID NO: 118847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggaatgcttgtattttcaaa

SEQ ID NO: 118848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtattttcaaaatagaagtt

SEQ ID NO: 118849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattttcaaaatagaagttt

SEQ ID NO: 118850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaaatagaagtttttgat

SEQ ID NO: 118851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaatagaagtttttgatt

SEQ ID NO: 118852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaatagaagtttttgattg

SEQ ID NO: 118853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgattgatacaaaatacta

SEQ ID NO: 118854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgattgatacaaaatactag

SEQ ID NO: 118855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gattgatacaaaatactaga

SEQ ID NO: 118856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attgatacaaaatactagat

SEQ ID NO: 118857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atacaaaatactagattact

SEQ ID NO: 118858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gattacttttctgggaaaaa

SEQ ID NO: 118859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttttctgggaaaaagaaaa

SEQ ID NO: 118860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctgggaaaaagaaaaaaa

SEQ ID NO: 118861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgggaaaaagaaaaaaat

SEQ ID NO: 118862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgggaaaaagaaaaaaatt

SEQ ID NO: 118863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgggaaaaagaaaaaaatta

SEQ ID NO: 118864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaaaaagaaaaaaattaaa

SEQ ID NO: 118865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataaaatatttattttatt

SEQ ID NO: 118866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttatttcaagagtgatt

SEQ ID NO: 118867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttatttcaagagtgattc

SEQ ID NO: 118868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttcaagagtgattctat

SEQ ID NO: 118869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttcaagagtgattctata

SEQ ID NO: 118870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcaagagtgattctatac

SEQ ID NO: 118871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caagagtgattctatacatc

SEQ ID NO: 118872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagagtgattctatacatca

SEQ ID NO: 118873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatacatcatctcaaagtca

SEQ ID NO: 118874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tacatcatctcaaagtcaag

SEQ ID NO: 118875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaagtcaagcaagagggaac

SEQ ID NO: 118876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggtttgaggactataggat

SEQ ID NO: 118877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtttgaggactataggatg

SEQ ID NO: 118878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtttgaggactataggatgg

SEQ ID NO: 118879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaggactataggatggtatt

SEQ ID NO: 118880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggactataggatggtatta

SEQ ID NO: 118881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taggatggtattaagaacta

SEQ ID NO: 118882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaactatgagaaagaacct

SEQ ID NO: 118883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgagaaagaacctgatttga

SEQ ID NO: 118884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atttgaattgcagttctgtt

SEQ ID NO: 118885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaattgcagttctgtttttt

SEQ ID NO: 118886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattgcagttctgttttttt

SEQ ID NO: 118887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagttctgtttttttcttgt

SEQ ID NO: 118888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtttttttcttgttgcatg

SEQ ID NO: 118889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttttttcttgttgcatgtg

SEQ ID NO: 118890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttcttgttgcatgtgata

SEQ ID NO: 118891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcttgttgcatgtgataa

SEQ ID NO: 118892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttgttgcatgtgataac

SEQ ID NO: 118893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttgttgcatgtgataaca

SEQ ID NO: 118894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgttgcatgtgataacat

SEQ ID NO: 118895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgttgcatgtgataacatg

SEQ ID NO: 118896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttgcatgtgataacatgtc

SEQ ID NO: 118897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgcatgtgataacatgtct

SEQ ID NO: 118898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catgtgataacatgtcttta

SEQ ID NO: 118899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacttctctaaaccacggtt

SEQ ID NO: 118900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttctctaaaccacggttt

SEQ ID NO: 118901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttctctaaaccacggtttc

SEQ ID NO: 118902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctctaaaccacggtttcctc

SEQ ID NO: 118903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctaaaccacggtttcctca

SEQ ID NO: 118904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taaaccacggtttcctcatt

SEQ ID NO: 118905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaccacggtttcctcattga

SEQ ID NO: 118906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctcattgaaaaagtggaag

SEQ ID NO: 118907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcattgaaaaagtggaagg

SEQ ID NO: 118908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attgaaaaagtggaaggcca

SEQ ID NO: 118909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaagtggaaggccaggtg

SEQ ID NO: 118910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgcctataatcccagcact

SEQ ID NO: 118911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatcccagcactttgggag

SEQ ID NO: 118912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgggaggccgaggggagtgg

SEQ ID NO: 118913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggaggccgaggggagtgga

SEQ ID NO: 118914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaggccgaggggagtggat

SEQ ID NO: 118915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agctactcaagaggctgaga

SEQ ID NO: 118916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcaagaggctgagacagga

SEQ ID NO: 118917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagaggctgagacaggatgt

SEQ ID NO: 118918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agacaggatgtttgcttgag

SEQ ID NO: 118919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttgagcccctggggatgg

SEQ ID NO: 118920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttgagcccctggggatgga

SEQ ID NO: 118921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagcccctggggatggaggt

SEQ ID NO: 118922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agcccctggggatggaggtt

SEQ ID NO: 118923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gggatggaggttgcagtgaa

SEQ ID NO: 118924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagtgaactgtgactgtgcc

SEQ ID NO: 118925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgactgtgccactgcactca

SEQ ID NO: 118926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgccactgcactcagcctgg

SEQ ID NO: 118927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cactcagcctgggagacaga

SEQ ID NO: 118928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcctgggagacagagtgag

SEQ ID NO: 118929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggagacagagtgagattgtg

SEQ ID NO: 118930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtttcaaaaaaagaaaaga

SEQ ID NO: 118931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaaaaagaaaagaaaaga

SEQ ID NO: 118932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaaaagaaaagaaaagaa

SEQ ID NO: 118933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccccatcttcattatatta

SEQ ID NO: 118934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattatattattgtgtgcat

SEQ ID NO: 118935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attatattattgtgtgcatt

SEQ ID NO: 118936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattattgtgtgcattacaa

SEQ ID NO: 118937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgtgtgcattacaatagat

SEQ ID NO: 118938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtgcattacaatagataat

SEQ ID NO: 118939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caatagataatgtacaaatc

SEQ ID NO: 118940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgtagatgctttataatg

SEQ ID NO: 118941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgtagatgctttataatgt

SEQ ID NO: 118942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtagatgctttataatgta

SEQ ID NO: 118943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tataatgtaaagtgagtaga

SEQ ID NO: 118944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataatgtaaagtgagtagag

SEQ ID NO: 118945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatgtaaagtgagtagagg

SEQ ID NO: 118946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatacatattaaatctcaaa

SEQ ID NO: 118947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatctcaaaatgctaagtgt

SEQ ID NO: 118948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaatgctaagtgtcaattc

SEQ ID NO: 118949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtgtcaattctttacttgt

SEQ ID NO: 118950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttacttgtgagataacaga

SEQ ID NO: 118951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacttgtgagataacagatt

SEQ ID NO: 118952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttgtgagataacagatta

SEQ ID NO: 118953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttgtgagataacagattag

SEQ ID NO: 118954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgagataacagattaggat

SEQ ID NO: 118955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgagataacagattaggatc

SEQ ID NO: 118956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggatcatggagaattatcta

SEQ ID NO: 118957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctaaaagtacatatgcctt

SEQ ID NO: 118958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaagtacatatgcctttcta

SEQ ID NO: 118959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctatggagaaatgctaagt

SEQ ID NO: 118960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatggagaaatgctaagtc

SEQ ID NO: 118961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatggagaaatgctaagtct

SEQ ID NO: 118962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggagaaatgctaagtcttt

SEQ ID NO: 118963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtctttttacaggaatcca

SEQ ID NO: 118964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttacaggaatccaaacttt

SEQ ID NO: 118965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttacaggaatccaaactttg

SEQ ID NO: 118966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacaggaatccaaactttgc

SEQ ID NO: 118967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaggaatccaaactttgct

SEQ ID NO: 118968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caggaatccaaactttgctt

SEQ ID NO: 118969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgctttagttacagtaacat

SEQ ID NO: 118970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctttagttacagtaacatc

SEQ ID NO: 118971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttagttacagtaacatca

SEQ ID NO: 118972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagttacagtaacatcatat

SEQ ID NO: 118973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agttacagtaacatcatatt

SEQ ID NO: 118974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttacagtaacatcatattc

SEQ ID NO: 118975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagtaacatcatattccaat

SEQ ID NO: 118976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caatcaactaaactaaacta

SEQ ID NO: 118977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aactaaactagcacagacaa

SEQ ID NO: 118978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aactagcacagacaaaaaga

SEQ ID NO: 118979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcacagacaaaaagaaaagt

SEQ ID NO: 118980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aattgaaaaattattgatca

SEQ ID NO: 118981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attgaaaaattattgatcac

SEQ ID NO: 118982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaattattgatcacatca

SEQ ID NO: 118983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgatcacatcacattactt

SEQ ID NO: 118984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcacatcacattacttaga

SEQ ID NO: 118985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttagaataaatgaagtata

SEQ ID NO: 118986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaataaatgaagtataagg

SEQ ID NO: 118987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaataaatgaagtataaggt

SEQ ID NO: 118988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagtatatcaaaatatgac

SEQ ID NO: 118989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataatactaaaaagccttat

SEQ ID NO: 118990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaagccttataaagttaaa

SEQ ID NO: 118991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataaagttaaaaatatatca

SEQ ID NO: 118992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaagttaaaaatatatcaa

SEQ ID NO: 118993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatatatcaaaatatgac

SEQ ID NO: 118994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataataaggctttttattat

SEQ ID NO: 118995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttattatctattatttcat

SEQ ID NO: 118996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattatctattatttcatt

SEQ ID NO: 118997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattatctattatttcattt

SEQ ID NO: 118998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attatctattatttcatttg

SEQ ID NO: 118999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatctattatttcatttga

SEQ ID NO: 119000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctattatttcatttgaagc

SEQ ID NO: 119001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttatttcatttgaagctgat

SEQ ID NO: 119002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcatttgaagctgataat

SEQ ID NO: 119003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catttgaagctgataatagc

SEQ ID NO: 119004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttgaagctgataatagca

SEQ ID NO: 119005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaagctgataatagcactac

SEQ ID NO: 119006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagctgataatagcactact

SEQ ID NO: 119007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ataatagcactactaaaaaa

SEQ ID NO: 119008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaaaaaagataccattaac

SEQ ID NO: 119009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaaagataccattaactat

SEQ ID NO: 119010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actatcacctgggagtcaac

SEQ ID NO: 119011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcacctgggagtcaacatga

SEQ ID NO: 119012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggagtcaacatgaatatgaa

SEQ ID NO: 119013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgatgaaacagcatcttacg

SEQ ID NO: 119014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatgaaacagcatcttacga

SEQ ID NO: 119015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgaaacagcatcttacgaa

SEQ ID NO: 119016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acgaaactaaggacttgtaa

SEQ ID NO: 119017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cgaaactaaggacttgtaat

SEQ ID NO: 119018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aggacttgtaatttgtacat

SEQ ID NO: 119019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaatttgtacattcgctta

SEQ ID NO: 119020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatttgtacattcgcttag

SEQ ID NO: 119021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtacattcgcttagaaaata

SEQ ID NO: 119022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tacattcgcttagaaaatag

SEQ ID NO: 119023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gcttagaaaatagtccttca

SEQ ID NO: 119024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaaaatagtccttcaagtc

SEQ ID NO: 119025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaaatagtccttcaagtca

SEQ ID NO: 119026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caagtcatccgccattagaa

SEQ ID NO: 119027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagtcatccgccattagaat

SEQ ID NO: 119028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaattgtttaaccttgcaag

SEQ ID NO: 119029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttaaccttgcaagagtact

SEQ ID NO: 119030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaccttgcaagagtactggg

SEQ ID NO: 119031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
accttgcaagagtactgggc

SEQ ID NO: 119032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcaagagtactgggcttggt

SEQ ID NO: 119033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caagagtactgggcttggtc

SEQ ID NO: 119034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcttggtcaaaagaaactc

SEQ ID NO: 119035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtcaaaagaaactcagctc

SEQ ID NO: 119036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtcaaaagaaactcagctct

SEQ ID NO: 119037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agctctataaatcatcatta

SEQ ID NO: 119038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tataaatcatcattatacta

SEQ ID NO: 119039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaatcatcattatactagc

SEQ ID NO: 119040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactagcaattcatcagcat

SEQ ID NO: 119041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcaattcatcagcatgttag

SEQ ID NO: 119042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcagcatgttagatcttgt

SEQ ID NO: 119043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatcttgtgtaaaaggcaca

SEQ ID NO: 119044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgtaaaaggcacaatgaaa

SEQ ID NO: 119045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtaaaaggcacaatgaaat

SEQ ID NO: 119046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgctgctatgatttttct

SEQ ID NO: 119047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgctgctatgatttttctc

SEQ ID NO: 119048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctgctatgatttttctcccc

SEQ ID NO: 119049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctatgatttttctccccaca

SEQ ID NO: 119050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgatttttctccccacaaca

SEQ ID NO: 119051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctccccacaacaaataat

SEQ ID NO: 119052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctccccacaacaaataatc

SEQ ID NO: 119053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctccccacaacaaataatct

SEQ ID NO: 119054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccccacaacaaataatcta

SEQ ID NO: 119055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cccacaacaaataatctaat

SEQ ID NO: 119056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttgttttgaagctccttt

SEQ ID NO: 119057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttttgaagctccttttagt

SEQ ID NO: 119058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttgaagctccttttagtg

SEQ ID NO: 119059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaagctccttttagtgatc

SEQ ID NO: 119060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaagctccttttagtgatcc

SEQ ID NO: 119061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagctccttttagtgatcct

SEQ ID NO: 119062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttttagtgatccttttcat

SEQ ID NO: 119063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttagtgatccttttcatgtc

SEQ ID NO: 119064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagtgatccttttcatgtct

SEQ ID NO: 119065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtgatccttttcatgtctc

SEQ ID NO: 119066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgatccttttcatgtctct

SEQ ID NO: 119067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcatgtctcttttctggaa

SEQ ID NO: 119068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatgtctcttttctggaaa

SEQ ID NO: 119069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgtctcttttctggaaag

SEQ ID NO: 119070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtctcttttctggaaagc

SEQ ID NO: 119071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttctggaaagccacctac

SEQ ID NO: 119072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctggaaagccacctacaa

SEQ ID NO: 119073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctggaaagccacctacaat

SEQ ID NO: 119074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctggaaagccacctacaatc

SEQ ID NO: 119075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggaaagccacctacaatcc

SEQ ID NO: 119076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaagccacctacaatcctt

SEQ ID NO: 119077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caatcctttgtgcaaacagg

SEQ ID NO: 119078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtgcaaacagggaaagaaa

SEQ ID NO: 119079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgcaaacagggaaagaaaa

SEQ ID NO: 119080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgcaaacagggaaagaaaaa

SEQ ID NO: 119081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaggtggaaatttccatca

SEQ ID NO: 119082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccatcactgacatcatagct

SEQ ID NO: 119083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catcactgacatcatagctg

SEQ ID NO: 119084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acatcatagctgtatgatta

SEQ ID NO: 119085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatgattagatgagaaaacc

SEQ ID NO: 119086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatgagaaaacccaaaatat

SEQ ID NO: 119087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcccctgatgtgaagcagc

SEQ ID NO: 119088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cccctgatgtgaagcagcag

SEQ ID NO: 119089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgtgaagcagcagtgtaag

SEQ ID NO: 119090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaatcatgtcctttgttatc

SEQ ID NO: 119091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatcatgtcctttgttatct

SEQ ID NO: 119092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgttatctttgccagaagct

SEQ ID NO: 119093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttatctttgccagaagctt

SEQ ID NO: 119094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttatctttgccagaagcttt

SEQ ID NO: 119095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctttgccagaagctttttc

SEQ ID NO: 119096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgccagaagctttttctcga

SEQ ID NO: 119097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccagaagctttttctcgag

SEQ ID NO: 119098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccagaagctttttctcgagg

SEQ ID NO: 119099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttctcgaggaactaaatgg

SEQ ID NO: 119100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctcgaggaactaaatgga

SEQ ID NO: 119101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctcgaggaactaaatggaa

SEQ ID NO: 119102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcgaggaactaaatggaag

SEQ ID NO: 119103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcgaggaactaaatggaagc

SEQ ID NO: 119104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gaggaactaaatggaagctt

SEQ ID NO: 119105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatggaagctttgactacat

SEQ ID NO: 119106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgactacatttcagacctca

SEQ ID NO: 119107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gactacatttcagacctcat

SEQ ID NO: 119108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actacatttcagacctcatg

SEQ ID NO: 119109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catttcagacctcatgaaag

SEQ ID NO: 119110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagacctcatgaaagaaata

SEQ ID NO: 119111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agacctcatgaaagaaataa

SEQ ID NO: 119112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgaaagaaataaattagat

SEQ ID NO: 119113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatttgagctgattttattg

SEQ ID NO: 119114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagctgattttattgtgaat

SEQ ID NO: 119115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agctgattttattgtgaata

SEQ ID NO: 119116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attttattgtgaatataccc

SEQ ID NO: 119117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattgtgaatataccccaat

SEQ ID NO: 119118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgtgaatataccccaatt

SEQ ID NO: 119119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgtgaatataccccaatta

SEQ ID NO: 119120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaatataccccaattactc

SEQ ID NO: 119121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctccaggagttaaaatatta

SEQ ID NO: 119122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caggagttaaaatattacag

SEQ ID NO: 119123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatattacagcctgtgtat

SEQ ID NO: 119124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagcctgtgtataagatggg

SEQ ID NO: 119125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtataagatgggtatctag

SEQ ID NO: 119126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtggcttcagtagagtcttt

SEQ ID NO: 119127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagtagagtctttaactatc

SEQ ID NO: 119128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtagagtctttaactatca

SEQ ID NO: 119129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taactatcatccatgtggaa

SEQ ID NO: 119130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactatcatccatgtggaag

SEQ ID NO: 119131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actatcatccatgtggaagg

SEQ ID NO: 119132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcatccatgtggaagggtag

SEQ ID NO: 119133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctatataatgccctgaatga

SEQ ID NO: 119134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tataatgccctgaatgaatg

SEQ ID NO: 119135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatgaatgaatcaatcaatg

SEQ ID NO: 119136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gattatgtggtactcaatgt

SEQ ID NO: 119137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attatgtggtactcaatgtt

SEQ ID NO: 119138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtggtactcaatgttcttt

SEQ ID NO: 119139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatgttctttcacagaatct

SEQ ID NO: 119140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcacagaatctctatttt

SEQ ID NO: 119141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcacagaatctctattttta

SEQ ID NO: 119142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacagaatctctatttttag

SEQ ID NO: 119143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acagaatctctatttttagg

SEQ ID NO: 119144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatttttaggatttcttcag

SEQ ID NO: 119145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttttaggatttcttcagga

SEQ ID NO: 119146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaggatttcttcaggacat

SEQ ID NO: 119147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taggatttcttcaggacatc

SEQ ID NO: 119148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggatttcttcaggacatca

SEQ ID NO: 119149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggatttcttcaggacatcat

SEQ ID NO: 119150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcaggacatcatgacaaa

SEQ ID NO: 119151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcaggacatcatgacaaaa

SEQ ID NO: 119152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caggacatcatgacaaaatt

SEQ ID NO: 119153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggacatcatgacaaaatta

SEQ ID NO: 119154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtactgaattgtggtgtgca

SEQ ID NO: 119155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aattgtggtgtgcataactt

SEQ ID NO: 119156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggtgtgcataacttagaaa

SEQ ID NO: 119157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaaaaaaatatgcataaag

SEQ ID NO: 119158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaaaaaatatgcataaagc

SEQ ID NO: 119159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccctgtgctacaaatgtaat

SEQ ID NO: 119160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgctacaaatgtaatttttt

SEQ ID NO: 119161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaatgtaattttttctata

SEQ ID NO: 119162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctataacaattagaaca

SEQ ID NO: 119163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctataacaattagaacat

SEQ ID NO: 119164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctataacaattagaacatg

SEQ ID NO: 119165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctataacaattagaacatgt

SEQ ID NO: 119166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tataacaattagaacatgtt

SEQ ID NO: 119167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taacaattagaacatgttat

SEQ ID NO: 119168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaacatgttattatcctcat

SEQ ID NO: 119169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatcctcattttaattcat

SEQ ID NO: 119170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcctcattttaattcatgga

SEQ ID NO: 119171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attttaattcatggagagtt

SEQ ID NO: 119172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattcatggagagttacag

SEQ ID NO: 119173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattcatggagagttacaga

SEQ ID NO: 119174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attcatggagagttacagat

SEQ ID NO: 119175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atggagagttacagatgttc

SEQ ID NO: 119176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagatgttcatttgagatag

SEQ ID NO: 119177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttgagatagatcaggagt

SEQ ID NO: 119178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagatagatcaggagtgggc

SEQ ID NO: 119179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agatagatcaggagtgggca

SEQ ID NO: 119180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagcttatatccgcctctt

SEQ ID NO: 119181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagcttatatccgcctcttt

SEQ ID NO: 119182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcttatatccgcctctttt

SEQ ID NO: 119183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atatccgcctcttttgaaaa

SEQ ID NO: 119184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatccgcctcttttgaaaac

SEQ ID NO: 119185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttgaaaactttcaccacg

SEQ ID NO: 119186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgaaaactttcaccacgtt

SEQ ID NO: 119187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaaaactttcaccacgttg

SEQ ID NO: 119188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaactttcaccacgttga

SEQ ID NO: 119189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaactttcaccacgttgag

SEQ ID NO: 119190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaccacgttgaggtcagta

SEQ ID NO: 119191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caccacgttgaggtcagtat

SEQ ID NO: 119192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accacgttgaggtcagtatg

SEQ ID NO: 119193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggtcagtatgctcttgaaa

SEQ ID NO: 119194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgaaaaaaagtaacaaaaa

SEQ ID NO: 119195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaaaaaagtaacaaaaaaa

SEQ ID NO: 119196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaaaagtaacaaaaaaaa

SEQ ID NO: 119197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgattgatataaaactaa

SEQ ID NO: 119198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgattgatataaaactaag

SEQ ID NO: 119199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attgatataaaactaagttc

SEQ ID NO: 119200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atataaaactaagttccaga

SEQ ID NO: 119201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agttccagaaaaacaatcta

SEQ ID NO: 119202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagaaaaacaatctaggcat

SEQ ID NO: 119203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggcatttcaaattaatagag

SEQ ID NO: 119204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaattaatagaggacaaaa

SEQ ID NO: 119205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaattaatagaggacaaaac

SEQ ID NO: 119206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atagaggacaaaacaaacaa

SEQ ID NO: 119207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccagaaaatcctgttgaaga

SEQ ID NO: 119208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgaagatgaaggtatttat

SEQ ID NO: 119209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagatgaaggtatttattgc

SEQ ID NO: 119210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgctttccttcttcctga

SEQ ID NO: 119211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgctttccttcttcctgag

SEQ ID NO: 119212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttccttcttcctgagctc

SEQ ID NO: 119213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccttcttcctgagctcctg

SEQ ID NO: 119214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttcttcctgagctcctga

SEQ ID NO: 119215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttcttcctgagctcctgat

SEQ ID NO: 119216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttcctgagctcctgatgtt

SEQ ID NO: 119217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcctgagctcctgatgttg

SEQ ID NO: 119218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctgagctcctgatgttgta

SEQ ID NO: 119219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgagctcctgatgttgtaa

SEQ ID NO: 119220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agctcctgatgttgtaagtt

SEQ ID NO: 119221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgatgttgtaagttgtcat

SEQ ID NO: 119222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgttgtaagttgtcatcat

SEQ ID NO: 119223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagttgtcatcattagtaa

SEQ ID NO: 119224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcatcattagtaatgaagat

SEQ ID NO: 119225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtaatgaagatggtatcgct

SEQ ID NO: 119226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttatattttccgctactac

SEQ ID NO: 119227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattttccgctactactacc

SEQ ID NO: 119228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccgctactactacctcctc

SEQ ID NO: 119229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccgctactactacctcctcc

SEQ ID NO: 119230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cgctactactacctcctccc

SEQ ID NO: 119231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctactacctcctccccaaat

SEQ ID NO: 119232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctacctcctccccaaataaa

SEQ ID NO: 119233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctcctccccaaataaaata

SEQ ID NO: 119234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctccccaaataaaataaacg

SEQ ID NO: 119235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cccaaataaaataaacgggg

SEQ ID NO: 119236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgctatatctttttattttc

SEQ ID NO: 119237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatctttttattttcatccc

SEQ ID NO: 119238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttattttcatcccaagaga

SEQ ID NO: 119239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattttcatcccaagagaa

SEQ ID NO: 119240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttcatcccaagagaat

SEQ ID NO: 119241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttcatcccaagagaata

SEQ ID NO: 119242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcatcccaagagaatat

SEQ ID NO: 119243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatcccaagagaatatctt

SEQ ID NO: 119244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catcccaagagaatatcttc

SEQ ID NO: 119245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcccaagagaatatcttct

SEQ ID NO: 119246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaacgatagaagtttatca

SEQ ID NO: 119247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taacgatagaagtttatcat

SEQ ID NO: 119248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acgatagaagtttatcatgt

SEQ ID NO: 119249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcatgttaggaagaaagca

SEQ ID NO: 119250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcatgttaggaagaaagcaa

SEQ ID NO: 119251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaagaaagcaactgtttaa

SEQ ID NO: 119252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttaaacatgggcattacac

SEQ ID NO: 119253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaacatgggcattacacatt

SEQ ID NO: 119254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacatgggcattacacatta

SEQ ID NO: 119255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacattacactttccaatat

SEQ ID NO: 119256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cactttccaatattactgaa

SEQ ID NO: 119257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccaatattactgaaaaaca

SEQ ID NO: 119258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaatattactgaaaaacaa

SEQ ID NO: 119259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caatattactgaaaaacaac

SEQ ID NO: 119260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgaaaaacaactgaatcta

SEQ ID NO: 119261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaaacaactgaatctagct

SEQ ID NO: 119262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatctagcttcctccctgaa

SEQ ID NO: 119263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcttcctccctgaatttggg

SEQ ID NO: 119264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctccctgaatttgggagta

SEQ ID NO: 119265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctccctgaatttgggagtat

SEQ ID NO: 119266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctgaatttgggagtattct

SEQ ID NO: 119267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatttgggagtattctgcac

SEQ ID NO: 119268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggagtattctgcactaaaa

SEQ ID NO: 119269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggagtattctgcactaaaat

SEQ ID NO: 119270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcactaaaatggctactaa

SEQ ID NO: 119271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cactaaaatggctactaaat

SEQ ID NO: 119272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatggctactaaattttgt

SEQ ID NO: 119273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaaattttgtcatctgcct

SEQ ID NO: 119274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattttgtcatctgccttga

SEQ ID NO: 119275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtcatctgccttgaaacaa

SEQ ID NO: 119276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcatctgccttgaaacaac

SEQ ID NO: 119277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcatctgccttgaaacaaca

SEQ ID NO: 119278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccttgaaacaacaaagatgg

SEQ ID NO: 119279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaacaacaaagatggagaa

SEQ ID NO: 119280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaacaacaaagatggagaag

SEQ ID NO: 119281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actgaaatatgaataaggaa

SEQ ID NO: 119282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgaaatatgaataaggaat

SEQ ID NO: 119283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaatatgaataaggaatgtc

SEQ ID NO: 119284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attctcctgctcctctgggc

SEQ ID NO: 119285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctgctcctctgggctttt

SEQ ID NO: 119286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgctcctctgggcttttga

SEQ ID NO: 119287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctcctctgggcttttgagta

SEQ ID NO: 119288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctctgggcttttgagtaacc

SEQ ID NO: 119289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgggcttttgagtaacctgt

SEQ ID NO: 119290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcttttgagtaacctgtgc

SEQ ID NO: 119291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgagtaacctgtgctgctg

SEQ ID NO: 119292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgagtaacctgtgctgctgt

SEQ ID NO: 119293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagtaacctgtgctgctgtg

SEQ ID NO: 119294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtaacctgtgctgctgtgg

SEQ ID NO: 119295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgctgctgtgggaggtaatt

SEQ ID NO: 119296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctgtgggaggtaatttgtat

SEQ ID NO: 119297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgggaggtaatttgtattac

SEQ ID NO: 119298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtattaccacttcgtgaaaa

SEQ ID NO: 119299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattaccacttcgtgaaaag

SEQ ID NO: 119300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccacttcgtgaaaagagtaa

SEQ ID NO: 119301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cgtgaaaagagtaaacaagc

SEQ ID NO: 119302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gtgaaaagagtaaacaagca

SEQ ID NO: 119303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccactatcccctttcccctg

SEQ ID NO: 119304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcccctttcccctgccttaa

SEQ ID NO: 119305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcccctgccttaatcaattt

SEQ ID NO: 119306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccctgccttaatcaatttc

SEQ ID NO: 119307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccctgccttaatcaatttct

SEQ ID NO: 119308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccttaatcaatttctcaaaa

SEQ ID NO: 119309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatcaatttctcaaaaagac

SEQ ID NO: 119310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcaatttctcaaaaagacc

SEQ ID NO: 119311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcaaaaagaccataggcca

SEQ ID NO: 119312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaaaaagaccataggccat

SEQ ID NO: 119313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaaagaccataggccataa

SEQ ID NO: 119314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatagatcatcacaaaagtc

SEQ ID NO: 119315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcattatttaggtctaact

SEQ ID NO: 119316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcattatttaggtctaacta

SEQ ID NO: 119317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attatttaggtctaactaaa

SEQ ID NO: 119318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaggtctaactaaattcc

SEQ ID NO: 119319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggtctaactaaattccaaa

SEQ ID NO: 119320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtctaactaaattccaaat

SEQ ID NO: 119321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actaaattccaaatgcaata

SEQ ID NO: 119322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattccaaatgcaatagcaa

SEQ ID NO: 119323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaatgcaatagcaaagatc

SEQ ID NO: 119324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcatgaaacttttcttctcc

SEQ ID NO: 119325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcttctccctcattagtga

SEQ ID NO: 119326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttctccctcattagtgaa

SEQ ID NO: 119327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttctccctcattagtgaac

SEQ ID NO: 119328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctccctcattagtgaacc

SEQ ID NO: 119329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctccctcattagtgaacctg

SEQ ID NO: 119330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccctcattagtgaacctgt

SEQ ID NO: 119331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctcattagtgaacctgttg

SEQ ID NO: 119332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attagtgaacctgttgtaac

SEQ ID NO: 119333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgaacctgttgtaacttgg

SEQ ID NO: 119334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgtaacttggcatttctca

SEQ ID NO: 119335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taacttggcatttctcatac

SEQ ID NO: 119336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcatttctcatacttgtct

SEQ ID NO: 119337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcatttctcatacttgtctt

SEQ ID NO: 119338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcatacttgtcttggaaaa

SEQ ID NO: 119339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcatacttgtcttggaaaag

SEQ ID NO: 119340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atacttgtcttggaaaagcc

SEQ ID NO: 119341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtcttggaaaagcctgaata

SEQ ID NO: 119342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttggaaaagcctgaatac

SEQ ID NO: 119343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaaaagcctgaataccttt

SEQ ID NO: 119344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaaagcctgaatacctttt

SEQ ID NO: 119345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aataccttttatttatctca

SEQ ID NO: 119346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatttatctcagcaaagta

SEQ ID NO: 119347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttatctcagcaaagtaa

SEQ ID NO: 119348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatctcagcaaagtaag

SEQ ID NO: 119349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatctcagcaaagtaaga

SEQ ID NO: 119350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctcagcaaagtaagattt

SEQ ID NO: 119351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctcagcaaagtaagatttt

SEQ ID NO: 119352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcaaagtaagattttaata

SEQ ID NO: 119353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatattttaaaacaactca

SEQ ID NO: 119354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatattttaaaacaactcaa

SEQ ID NO: 119355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atattttaaaacaactcaat

SEQ ID NO: 119356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaacaactcaatactgtc

SEQ ID NO: 119357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaacaactcaatactgtcc

SEQ ID NO: 119358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaacaactcaatactgtcca

SEQ ID NO: 119359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatactgtccagtagaaaat

SEQ ID NO: 119360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tccagtagaaaatgtattaa

SEQ ID NO: 119361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacttcttaaagtacataat

SEQ ID NO: 119362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttaaagtacataatacttg

SEQ ID NO: 119363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaaagtacataatacttga

SEQ ID NO: 119364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaagtacataatacttgagc

SEQ ID NO: 119365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtacataatacttgagcc

SEQ ID NO: 119366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagccgtcaaagacacacag

SEQ ID NO: 119367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agccgtcaaagacacacaga

SEQ ID NO: 119368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taggggcatttctcctaata

SEQ ID NO: 119369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggggcatttctcctaataaa

SEQ ID NO: 119370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcctaataaatgtgagatg

SEQ ID NO: 119371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctaataaatgtgagatgc

SEQ ID NO: 119372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctaataaatgtgagatgctc

SEQ ID NO: 119373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ataaatgtgagatgctctgc

SEQ ID NO: 119374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgctcaagctgggaaaaaat

SEQ ID NO: 119375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctcaagctgggaaaaaatat

SEQ ID NO: 119376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagctgggaaaaaatatgta

SEQ ID NO: 119377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaaaaaatatgtatctcct

SEQ ID NO: 119378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgtttgtgaaagatatggt

SEQ ID NO: 119379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttgtgaaagatatggttca

SEQ ID NO: 119380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgaaagatatggttcagct

SEQ ID NO: 119381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaaagatatggttcagctg

SEQ ID NO: 119382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agctgctaccctgacaacaa

SEQ ID NO: 119383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctaccctgacaacaaaacca

SEQ ID NO: 119384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccctgacaacaaaaccaagc

SEQ ID NO: 119385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acaacaaaaccaagcacatt

SEQ ID NO: 119386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgacctaagggactgcaga

SEQ ID NO: 119387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agggactgcagagatacctg

SEQ ID NO: 119388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagagatacctgctattgtt

SEQ ID NO: 119389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctattgtttgacaccaaaag

SEQ ID NO: 119390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgtttgacaccaaaaggaa

SEQ ID NO: 119391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgacaccaaaaggaattg

SEQ ID NO: 119392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacaccaaaaggaattggaa

SEQ ID NO: 119393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acaccaaaaggaattggaaa

SEQ ID NO: 119394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaacttactaaatatggag

SEQ ID NO: 119395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actaaatatggagcaggtgc

SEQ ID NO: 119396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaaatatggagcaggtgca

SEQ ID NO: 119397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatatggagcaggtgcagag

SEQ ID NO: 119398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcattgttctctctaaagcg

SEQ ID NO: 119399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttctctctaaagcgtgggtt

SEQ ID NO: 119400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctctaaagcgtgggttcag

SEQ ID NO: 119401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctaaagcgtgggttcaggt

SEQ ID NO: 119402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taaagcgtgggttcaggtgg

SEQ ID NO: 119403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagcgtgggttcaggtggga

SEQ ID NO: 119404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggtgggaatcaagctcatt

SEQ ID NO: 119405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attgaaaagtatatgatata

SEQ ID NO: 119406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaagtatatgatatataaa

SEQ ID NO: 119407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgatagtaggtgaaaagcc

SEQ ID NO: 119408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgatagtaggtgaaaagcca

SEQ ID NO: 119409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcacaatagttttgagaaaa

SEQ ID NO: 119410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cacaatagttttgagaaaag

SEQ ID NO: 119411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgagaaaagcatttaaattg

SEQ ID NO: 119412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagaaaagcatttaaattgt

SEQ ID NO: 119413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaaaagcatttaaattgtt

SEQ ID NO: 119414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattgtttgaacctcacac

SEQ ID NO: 119415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattgtttgaacctcacact

SEQ ID NO: 119416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgaacctcacactagaca

SEQ ID NO: 119417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaacctcacactagacagaa

SEQ ID NO: 119418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacctcacactagacagaac

SEQ ID NO: 119419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acactagacagaactctgaa

SEQ ID NO: 119420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gacagaactctgaagagatg

SEQ ID NO: 119421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgaagagatggatatttcaa

SEQ ID NO: 119422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagagatggatatttcaaat

SEQ ID NO: 119423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaatgaaaaaataaaatag

SEQ ID NO: 119424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaatgaaaaaataaaatagg

SEQ ID NO: 119425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggactgggagtgagtcatcc

SEQ ID NO: 119426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggagtgagtcatccatgtgt

SEQ ID NO: 119427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcccatttctccacatcaat

SEQ ID NO: 119428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctccacatcaatttgctgac

SEQ ID NO: 119429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccacatcaatttgctgaca

SEQ ID NO: 119430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cacatcaatttgctgacatc

SEQ ID NO: 119431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctgacatctgccttgtcca

SEQ ID NO: 119432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgacatctgccttgtccac

SEQ ID NO: 119433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acatctgccttgtccacttt

SEQ ID NO: 119434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccttgtccactttttaaaat

SEQ ID NO: 119435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtccactttttaaaatattt

SEQ ID NO: 119436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tccactttttaaaatatttt

SEQ ID NO: 119437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttaaaatatttttagttat

SEQ ID NO: 119438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaatatttttagttatt

SEQ ID NO: 119439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaatatttttagttatta

SEQ ID NO: 119440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatatttttagttattac

SEQ ID NO: 119441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatatttttagttattaca

SEQ ID NO: 119442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagttattacagtgatgct

SEQ ID NO: 119443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagttattacagtgatgctg

SEQ ID NO: 119444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agttattacagtgatgctga

SEQ ID NO: 119445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttattacagtgatgctgaa

SEQ ID NO: 119446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttacagtgatgctgaactaa

SEQ ID NO: 119447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagtgatgctgaactaataa

SEQ ID NO: 119448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aactaataagaatggtgttt

SEQ ID NO: 119449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ataagaatggtgtttagaga

SEQ ID NO: 119450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agagagaacataagaagagt

SEQ ID NO: 119451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagagaacataagaagagta

SEQ ID NO: 119452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagagtctgtctaaaatctt

SEQ ID NO: 119453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agagtctgtctaaaatcttt

SEQ ID NO: 119454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctaaaatctttaggcactg

SEQ ID NO: 119455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatctttaggcactggtcc

SEQ ID NO: 119456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taggcactggtccatcactc

SEQ ID NO: 119457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggcactggtccatcactct

SEQ ID NO: 119458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggcactggtccatcactctt

SEQ ID NO: 119459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtccatcactcttgccgtct

SEQ ID NO: 119460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgccgtctttatagcccat

SEQ ID NO: 119461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gccgtctttatagcccattc

SEQ ID NO: 119462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccgtctttatagcccattcc

SEQ ID NO: 119463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatagcccattcctctctct

SEQ ID NO: 119464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagcccattcctctctctc

SEQ ID NO: 119465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagcccattcctctctctct

SEQ ID NO: 119466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctctctctctttcttcttat

SEQ ID NO: 119467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctctctttcttcttattct

SEQ ID NO: 119468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctctttcttcttattctcc

SEQ ID NO: 119469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctttcttcttattctcctt

SEQ ID NO: 119470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttcttcttattctcctttg

SEQ ID NO: 119471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttcttattctcctttggg

SEQ ID NO: 119472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcttattctcctttggga

SEQ ID NO: 119473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcttattctcctttgggat

SEQ ID NO: 119474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttattctcctttgggatct

SEQ ID NO: 119475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttattctcctttgggatctt

SEQ ID NO: 119476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attctcctttgggatctttt

SEQ ID NO: 119477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctcctttgggatctttta

SEQ ID NO: 119478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctttgggatcttttattt

SEQ ID NO: 119479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctttgggatcttttattttt

SEQ ID NO: 119480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgggatcttttatttttttg

SEQ ID NO: 119481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggatcttttatttttttga

SEQ ID NO: 119482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggatcttttatttttttgag

SEQ ID NO: 119483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatttttttgagtattctg

SEQ ID NO: 119484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttttttgagtattctgt

SEQ ID NO: 119485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttttttgagtattctgtt

SEQ ID NO: 119486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttttgagtattctgttg

SEQ ID NO: 119487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttgagtattctgttgttt

SEQ ID NO: 119488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgagtattctgttgtttc

SEQ ID NO: 119489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgagtattctgttgtttcc

SEQ ID NO: 119490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgagtattctgttgtttcca

SEQ ID NO: 119491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagtattctgttgtttccaa

SEQ ID NO: 119492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtattctgttgtttccaat

SEQ ID NO: 119493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttgtttccaattacacct

SEQ ID NO: 119494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgtttccaattacacctac

SEQ ID NO: 119495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttccaattacacctacaac

SEQ ID NO: 119496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaattacacctacaacttc

SEQ ID NO: 119497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caattacacctacaacttct

SEQ ID NO: 119498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacctacaacttctggcaaa

SEQ ID NO: 119499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caacttctggcaaaaaatat

SEQ ID NO: 119500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctggcaaaaaatataaaata

SEQ ID NO: 119501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggcaaaaaatataaaatac

SEQ ID NO: 119502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcaaaaaatataaaatactt

SEQ ID NO: 119503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taataggacatcaagtaatt

SEQ ID NO: 119504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aataggacatcaagtaatta

SEQ ID NO: 119505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataggacatcaagtaattat

SEQ ID NO: 119506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcagaatacagatgaaaa

SEQ ID NO: 119507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagaatacagatgaaaataa

SEQ ID NO: 119508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaatacagatgaaaataat

SEQ ID NO: 119509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catagcattgtcctaaatcc

SEQ ID NO: 119510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atagcattgtcctaaatcca

SEQ ID NO: 119511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcctaaatccagagggttca

SEQ ID NO: 119512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatccagagggttcatgaat

SEQ ID NO: 119513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgaatcattgctcttagaa

SEQ ID NO: 119514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcttagaaagctcttgaca

SEQ ID NO: 119515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttagaaagctcttgacaccc

SEQ ID NO: 119516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaaagctcttgacacccag

SEQ ID NO: 119517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaagctcttgacacccagg

SEQ ID NO: 119518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgacacccaggggataggt

SEQ ID NO: 119519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacacccaggggataggttt

SEQ ID NO: 119520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acacccaggggataggtttt

SEQ ID NO: 119521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatgcagaaaatcaccctg

SEQ ID NO: 119522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgcagaaaatcaccctgg

SEQ ID NO: 119523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgcagaaaatcaccctggg

SEQ ID NO: 119524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggagatcaacatgcctagtg

SEQ ID NO: 119525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtggttgatgtacctcatgt

SEQ ID NO: 119526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgtacctcatgtacaagat

SEQ ID NO: 119527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgtacaagatgtgtttgtt

SEQ ID NO: 119528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttctcctgacttagtaaa

SEQ ID NO: 119529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttctcctgacttagtaaag

SEQ ID NO: 119530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcctgacttagtaaagagc

SEQ ID NO: 119531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctgacttagtaaagagct

SEQ ID NO: 119532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgacttagtaaagagctat

SEQ ID NO: 119533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acttagtaaagagctattta

SEQ ID NO: 119534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtaaagagctatttaagtg

SEQ ID NO: 119535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtaaagagctatttaagtgg

SEQ ID NO: 119536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttaagtggacccctggttg

SEQ ID NO: 119537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagtggacccctggttgggg

SEQ ID NO: 119538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtggacccctggttgggga

SEQ ID NO: 119539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttggggaggaaagccttga

SEQ ID NO: 119540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggaggaaagccttgagttc

SEQ ID NO: 119541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagttctgtgctatttagaa

SEQ ID NO: 119542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agttctgtgctatttagaat

SEQ ID NO: 119543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtgctatttagaatgcctc

SEQ ID NO: 119544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgctatttagaatgcctctc

SEQ ID NO: 119545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttagaatgcctctcaacta

SEQ ID NO: 119546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaatgcctctcaactaaat

SEQ ID NO: 119547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatgcctctcaactaaatg

SEQ ID NO: 119548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaactaaatgctttgtaat

SEQ ID NO: 119549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aactaaatgctttgtaatta

SEQ ID NO: 119550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatgctttgtaattaactaa

SEQ ID NO: 119551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtaattaactaattaatgt

SEQ ID NO: 119552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaattaactaattaatgtt

SEQ ID NO: 119553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taattaactaattaatgttc

SEQ ID NO: 119554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actaattaatgttcacaaca

SEQ ID NO: 119555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attaatgttcacaacacacc

SEQ ID NO: 119556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgttcacaacacacctgtg

SEQ ID NO: 119557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaacacacctgtggcattg

SEQ ID NO: 119558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggcattgctgctactattc

SEQ ID NO: 119559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgctactattccatcattt

SEQ ID NO: 119560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctactattccatcatttttc

SEQ ID NO: 119561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctattccatcatttttcctg

SEQ ID NO: 119562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttccatcatttttcctgagt

SEQ ID NO: 119563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catcatttttcctgagtaat

SEQ ID NO: 119564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcctgagtaataaacacat

SEQ ID NO: 119565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctgagtaataaacacatt

SEQ ID NO: 119566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgagtaataaacacatta

SEQ ID NO: 119567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgagtaataaacacattaa

SEQ ID NO: 119568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtaataaacacattaagac

SEQ ID NO: 119569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agactttatatgaagtaatc

SEQ ID NO: 119570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatatgaagtaatcaataaa

SEQ ID NO: 119571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatgaagtaatcaataaat

SEQ ID NO: 119572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatgaagtaatcaataaatg

SEQ ID NO: 119573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattacctggaattcactgg

SEQ ID NO: 119574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctggaattcactggtagcc

SEQ ID NO: 119575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaattcactggtagccaatc

SEQ ID NO: 119576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actggtagccaatcgtaacc

SEQ ID NO: 119577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtagccaatcgtaacccagc

SEQ ID NO: 119578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcacaggcatttaaagttc

SEQ ID NO: 119579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacaggcatttaaagttcat

SEQ ID NO: 119580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaggcatttaaagttcatg

SEQ ID NO: 119581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagttcatgccacagaatt

SEQ ID NO: 119582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagttcatgccacagaattt

SEQ ID NO: 119583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgccacagaatttaaagag

SEQ ID NO: 119584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagaggctgttacactctg

SEQ ID NO: 119585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagaggctgttacactctga

SEQ ID NO: 119586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttacactctgatctagaact

SEQ ID NO: 119587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cactctgatctagaacttgt

SEQ ID NO: 119588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgatctagaacttgtataat

SEQ ID NO: 119589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atctagaacttgtataataa

SEQ ID NO: 119590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaacttgtataataaggtca

SEQ ID NO: 119591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtataataaggtcatgaaga

SEQ ID NO: 119592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tataataaggtcatgaagag

SEQ ID NO: 119593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaaaaacacataggatc

SEQ ID NO: 119594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaaaacacataggatcg

SEQ ID NO: 119595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtcatatttgaattccagat

SEQ ID NO: 119596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaattccagataagtccagg

SEQ ID NO: 119597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattccagataagtccagga

SEQ ID NO: 119598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagataagtccaggacctac

SEQ ID NO: 119599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cataggaaattggcaacttt

SEQ ID NO: 119600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcaacttttcacaggcatgt

SEQ ID NO: 119601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcacaggcatgttccagaa

SEQ ID NO: 119602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcacaggcatgttccagaag

SEQ ID NO: 119603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacaggcatgttccagaagg

SEQ ID NO: 119604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaggcatgttccagaagga

SEQ ID NO: 119605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagaaggaccaaaccttttt

SEQ ID NO: 119606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttcctatggcaagatggta

SEQ ID NO: 119607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcctatggcaagatggtag

SEQ ID NO: 119608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctatggcaagatggtagg

SEQ ID NO: 119609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctatggcaagatggtaggt

SEQ ID NO: 119610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctatggcaagatggtaggtt

SEQ ID NO: 119611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggcaagatggtaggttctt

SEQ ID NO: 119612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttccagcttctctgctaaca

SEQ ID NO: 119613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccagcttctctgctaacaat

SEQ ID NO: 119614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagcttctctgctaacaatc

SEQ ID NO: 119615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctctgctaacaatctgtggc

SEQ ID NO: 119616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgctaacaatctgtggct

SEQ ID NO: 119617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgctaacaatctgtggctcc

SEQ ID NO: 119618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctaacaatctgtggctccag

SEQ ID NO: 119619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acaatctgtggctccagaga

SEQ ID NO: 119620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggctccagagaggaagagg

SEQ ID NO: 119621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagagaggaagaggcaagag

SEQ ID NO: 119622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgagccaatgaaaattagt

SEQ ID NO: 119623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttaatataccaccttagca

SEQ ID NO: 119624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atataccaccttagcacatg

SEQ ID NO: 119625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agcacatgtgtaacggtttg

SEQ ID NO: 119626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcacatgtgtaacggtttgt

SEQ ID NO: 119627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttgattatcatgtacattt

SEQ ID NO: 119628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgattatcatgtacatttt

SEQ ID NO: 119629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attatcatgtacatttttcc

SEQ ID NO: 119630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcatgtacatttttcctaca

SEQ ID NO: 119631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcctacaaactaagaatag

SEQ ID NO: 119632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctacaaactaagaataga

SEQ ID NO: 119633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctacaaactaagaatagaa

SEQ ID NO: 119634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctacaaactaagaatagaaa

SEQ ID NO: 119635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaactaagaatagaaagtc

SEQ ID NO: 119636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaatagaaagtcttccaac

SEQ ID NO: 119637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaacattaaaaaaaaaaaa

SEQ ID NO: 119638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caacattaaaaaaaaaaaat

SEQ ID NO: 119639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaaaaaaatgacaagta

SEQ ID NO: 119640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttccagcctagatatgcc

SEQ ID NO: 119641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccagcctagatatgcccct

SEQ ID NO: 119642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccagcctagatatgcccctc

SEQ ID NO: 119643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagcctagatatgcccctca

SEQ ID NO: 119644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatatgcccctcaagttcca

SEQ ID NO: 119645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagttccacaaactctaatt

SEQ ID NO: 119646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacaaactctaatttttcat

SEQ ID NO: 119647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taatttttcatatactctta

SEQ ID NO: 119648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttttcatatactcttatt

SEQ ID NO: 119649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcatatactcttattttaa

SEQ ID NO: 119650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatatactcttattttaac

SEQ ID NO: 119651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catatactcttattttaacc

SEQ ID NO: 119652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatactcttattttaaccc

SEQ ID NO: 119653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttattttaacccgctcattt

SEQ ID NO: 119654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attttaacccgctcatttaa

SEQ ID NO: 119655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaacccgctcatttaaa

SEQ ID NO: 119656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacccgctcatttaaatga

SEQ ID NO: 119657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacccgctcatttaaatgat

SEQ ID NO: 119658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acccgctcatttaaatgatt

SEQ ID NO: 119659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atttaaatgattgccagtca

SEQ ID NO: 119660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatgattgccagtcagtag

SEQ ID NO: 119661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgattgccagtcagtagc

SEQ ID NO: 119662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccagtcagtagccagtgcta

SEQ ID NO: 119663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtaataaaaagtaccattta

SEQ ID NO: 119664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actccctgggaactcagaat

SEQ ID NO: 119665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctccctgggaactcagaata

SEQ ID NO: 119666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctgggaactcagaatagag

SEQ ID NO: 119667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaactcagaatagagtaac

SEQ ID NO: 119668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaatagagtaacatctaat

SEQ ID NO: 119669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atcaacaagggctattgatt

SEQ ID NO: 119670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgattatactttctaaatc

SEQ ID NO: 119671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attatactttctaaatcaac

SEQ ID NO: 119672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactttctaaatcaacccta

SEQ ID NO: 119673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctaaatcaaccctaaaccc

SEQ ID NO: 119674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaaatcaaccctaaaccct

SEQ ID NO: 119675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaatcaaccctaaaccctt

SEQ ID NO: 119676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatcaaccctaaaccctttc

SEQ ID NO: 119677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaccctttccctttgctttt

SEQ ID NO: 119678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccctttgctttttctcttt

SEQ ID NO: 119679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctttgctttttctcttta

SEQ ID NO: 119680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctttgctttttctctttat

SEQ ID NO: 119681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgctttttctctttatcttt

SEQ ID NO: 119682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctttttctctttatctttt

SEQ ID NO: 119683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttttctctttatctttta

SEQ ID NO: 119684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttctctttatcttttatct

SEQ ID NO: 119685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctctttatcttttatctg

SEQ ID NO: 119686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctctttatcttttatctgt

SEQ ID NO: 119687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctttatcttttatctgta

SEQ ID NO: 119688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctttatcttttatctgtac

SEQ ID NO: 119689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttatcttttatctgtacta

SEQ ID NO: 119690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatcttttatctgtactatc

SEQ ID NO: 119691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttttatctgtactatca

SEQ ID NO: 119692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttttatctgtactatcac

SEQ ID NO: 119693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatctgtactatcacaatg

SEQ ID NO: 119694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatctgtactatcacaatgg

SEQ ID NO: 119695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctgtactatcacaatggt

SEQ ID NO: 119696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgtactatcacaatggtc

SEQ ID NO: 119697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tactatcacaatggtctcca

SEQ ID NO: 119698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcacaatggtctccaagtct

SEQ ID NO: 119699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caagtctctaggtttccact

SEQ ID NO: 119700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taggtttccactctcatttt

SEQ ID NO: 119701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtttccactctcattttgt

SEQ ID NO: 119702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccactctcattttgtcttat

SEQ ID NO: 119703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cactctcattttgtcttatc

SEQ ID NO: 119704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcattttgtcttatccacag

SEQ ID NO: 119705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attttgtcttatccacagaa

SEQ ID NO: 119706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtcttatccacagaatata

SEQ ID NO: 119707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcttatccacagaatatat

SEQ ID NO: 119708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttatccacagaatatata

SEQ ID NO: 119709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atccacagaatatatagtac

SEQ ID NO: 119710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccacagaatatatagtact

SEQ ID NO: 119711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcagagtggtaattaaaaat

SEQ ID NO: 119712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaattgatcacatctctct

SEQ ID NO: 119713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcacatctctcttctgtta

SEQ ID NO: 119714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcttctgttaaaaaatcatc

SEQ ID NO: 119715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttctgttaaaaaatcatcag

SEQ ID NO: 119716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgttaaaaaatcatcagtg

SEQ ID NO: 119717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttaaaaaatcatcagtgg

SEQ ID NO: 119718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttaaaaaatcatcagtggct

SEQ ID NO: 119719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaatcatcagtggcttct

SEQ ID NO: 119720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcaatagcttatgggatta

SEQ ID NO: 119721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaatagcttatgggattaa

SEQ ID NO: 119722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatagcttatgggattaacc

SEQ ID NO: 119723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgggattaacccacaaggg

SEQ ID NO: 119724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgggattaacccacaagggc

SEQ ID NO: 119725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acccacaagggcctgtccta

SEQ ID NO: 119726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcctaagtggtcccagccca

SEQ ID NO: 119727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtggtcccagcccaatttc

SEQ ID NO: 119728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgatactcattcccaccc

SEQ ID NO: 119729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgatactcattcccaccca

SEQ ID NO: 119730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atactcattcccacccacct

SEQ ID NO: 119731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attcccacccacctatctag

SEQ ID NO: 119732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccacccacctatctaggact

SEQ ID NO: 119733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctaggactcaagatcctag

SEQ ID NO: 119734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggactcaagatcctagatag

SEQ ID NO: 119735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagatcctagataggtggct

SEQ ID NO: 119736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gataggtggctatgctccaa

SEQ ID NO: 119737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgctccaatagggcatttta

SEQ ID NO: 119738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caatagggcattttaattct

SEQ ID NO: 119739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattcttccctcaggagcc

SEQ ID NO: 119740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattcttccctcaggagcca

SEQ ID NO: 119741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attcttccctcaggagccag

SEQ ID NO: 119742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttccctcaggagccagtcca

SEQ ID NO: 119743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctcaggagccagtccaag

SEQ ID NO: 119744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctcaggagccagtccaaga

SEQ ID NO: 119745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggagccagtccaagagttt

SEQ ID NO: 119746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaacctacaactacttttc

SEQ ID NO: 119747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaacctacaactacttttct

SEQ ID NO: 119748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacctacaactacttttctt

SEQ ID NO: 119749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caactacttttcttaaacct

SEQ ID NO: 119750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttttcttaaacctccaaag

SEQ ID NO: 119751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcttaaacctccaaagtag

SEQ ID NO: 119752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttaaacctccaaagtagt

SEQ ID NO: 119753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttaaacctccaaagtagtg

SEQ ID NO: 119754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaaacctccaaagtagtgg

SEQ ID NO: 119755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaacctccaaagtagtggcc

SEQ ID NO: 119756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacctccaaagtagtggccg

SEQ ID NO: 119757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caaagtagtggccgggtgca

SEQ ID NO: 119758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acgtctgtaatcccaacact

SEQ ID NO: 119759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taatcccaacactttgggag

SEQ ID NO: 119760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgggaggcagaggtgggcag

SEQ ID NO: 119761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggaggcagaggtgggcaga

SEQ ID NO: 119762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaggcagaggtgggcagat

SEQ ID NO: 119763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaggtcggaagttcaagacc

SEQ ID NO: 119764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggtcggaagttcaagacca

SEQ ID NO: 119765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagaccagcctgaccaacat

SEQ ID NO: 119766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
accaacatggagaaactcca

SEQ ID NO: 119767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catctctactaaaaaaaata

SEQ ID NO: 119768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tactaaaaaaaatacaaaat

SEQ ID NO: 119769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaaaaaaaatacaaaatta

SEQ ID NO: 119770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaaaaatacaaaattagcc

SEQ ID NO: 119771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccgggcgtggtggcgcgtg

SEQ ID NO: 119772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataatcccggctcctcggaa

SEQ ID NO: 119773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatcccggctcctcggaag

SEQ ID NO: 119774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcggaaggctgaggcagga

SEQ ID NO: 119775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggaaggctgaggcaggagaa

SEQ ID NO: 119776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggcaggagaatcgcttgaa

SEQ ID NO: 119777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaacccaggagcggagattg

SEQ ID NO: 119778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacccaggagcggagattgc

SEQ ID NO: 119779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cggtgagccgagatcacgcc

SEQ ID NO: 119780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cacttcaggatgggcaacaa

SEQ ID NO: 119781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caggatgggcaacaagagca

SEQ ID NO: 119782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggatgggcaacaagagcaa

SEQ ID NO: 119783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cgtcaaaacaaacaaacaaa

SEQ ID NO: 119784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctctcatcatgatttgacat

SEQ ID NO: 119785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcatcatgatttgacataat

SEQ ID NO: 119786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atcatgatttgacataatca

SEQ ID NO: 119787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacataatcaccctccccca

SEQ ID NO: 119788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acataatcaccctcccccaa

SEQ ID NO: 119789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccccaagctgtgaccatctt

SEQ ID NO: 119790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgaccatcttattcatcttt

SEQ ID NO: 119791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attcatctttctactcccat

SEQ ID NO: 119792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcatctttctactcccata

SEQ ID NO: 119793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atctttctactcccatattt

SEQ ID NO: 119794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctactcccatatttagccc

SEQ ID NO: 119795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctactcccatatttagccca

SEQ ID NO: 119796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tactcccatatttagcccaa

SEQ ID NO: 119797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcccatatttagcccaatg

SEQ ID NO: 119798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccatatttagcccaatgggg

SEQ ID NO: 119799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcccaatggggtacataga

SEQ ID NO: 119800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcccaatggggtacatagaa

SEQ ID NO: 119801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attcagttgtatacactctt

SEQ ID NO: 119802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcagttgtatacactcttt

SEQ ID NO: 119803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agttgtatacactctttctc

SEQ ID NO: 119804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatacactctttctctattc

SEQ ID NO: 119805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttctctattccttacttta

SEQ ID NO: 119806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctctattccttactttaaa

SEQ ID NO: 119807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctattccttactttaaaa

SEQ ID NO: 119808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctattccttactttaaaaa

SEQ ID NO: 119809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tattccttactttaaaaaga

SEQ ID NO: 119810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttccttactttaaaaagaag

SEQ ID NO: 119811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttactttaaaaagaaggaa

SEQ ID NO: 119812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actttaaaaagaaggaaaca

SEQ ID NO: 119813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttaaaaagaaggaaacag

SEQ ID NO: 119814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaaaagaaggaaacagaaa

SEQ ID NO: 119815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaagaaggaaacagaaaa

SEQ ID NO: 119816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaagaaggaaacagaaaaa

SEQ ID NO: 119817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaatgtaaggaaccaatga

SEQ ID NO: 119818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtaatgagttctttttact

SEQ ID NO: 119819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttactgttgtatttgtt

SEQ ID NO: 119820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttactgttgtatttgttat

SEQ ID NO: 119821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttactgttgtatttgttatc

SEQ ID NO: 119822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tactgttgtatttgttatca

SEQ ID NO: 119823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actgttgtatttgttatcat

SEQ ID NO: 119824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgttgtatttgttatcatt

SEQ ID NO: 119825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgtatttgttatcattttc

SEQ ID NO: 119826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatttgttatcattttctaa

SEQ ID NO: 119827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttatcattttctaaatagt

SEQ ID NO: 119828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttatcattttctaaatagtc

SEQ ID NO: 119829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcattttctaaatagtctca

SEQ ID NO: 119830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctaaatagtctcattttat

SEQ ID NO: 119831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaaatagtctcattttatt

SEQ ID NO: 119832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaatagtctcattttattt

SEQ ID NO: 119833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatagtctcattttatttat

SEQ ID NO: 119834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attttatttatttcaattta

SEQ ID NO: 119835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttatttcaatttatgca

SEQ ID NO: 119836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttcaatttatgcat

SEQ ID NO: 119837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttcaatttatgcatt

SEQ ID NO: 119838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttcaatttatgcattgaa

SEQ ID NO: 119839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcaatttatgcattgaac

SEQ ID NO: 119840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatttatgcattgaaccat

SEQ ID NO: 119841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatttatgcattgaaccata

SEQ ID NO: 119842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgcattgaaccatatgttt

SEQ ID NO: 119843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcattgaaccatatgtttt

SEQ ID NO: 119844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaccatatgttttactaatc

SEQ ID NO: 119845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tactaatctactgtgtactt

SEQ ID NO: 119846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actaatctactgtgtacttc

SEQ ID NO: 119847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaatctactgtgtacttcc

SEQ ID NO: 119848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atctactgtgtacttccact

SEQ ID NO: 119849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgtgtacttccacttcatt

SEQ ID NO: 119850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtacttccacttcattttg

SEQ ID NO: 119851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccacttcattttgcaattta

SEQ ID NO: 119852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacttcattttgcaatttag

SEQ ID NO: 119853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattttgcaatttaggagta

SEQ ID NO: 119854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attttgcaatttaggagtat

SEQ ID NO: 119855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcaatttaggagtatttca

SEQ ID NO: 119856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaatttaggagtatttcaa

SEQ ID NO: 119857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caatttaggagtatttcaat

SEQ ID NO: 119858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggagtatttcaatggtcag

SEQ ID NO: 119859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggagtatttcaatggtcaga

SEQ ID NO: 119860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatggtcagagaaaatgaa

SEQ ID NO: 119861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatggtcagagaaaatgaaa

SEQ ID NO: 119862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttaattctgaaaattagaat

SEQ ID NO: 119863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attctgaaaattagaatctc

SEQ ID NO: 119864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaaaattagaatctctcta

SEQ ID NO: 119865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaattagaatctctctaca

SEQ ID NO: 119866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatctctctacaaactttt

SEQ ID NO: 119867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctacaaacttttaaattag

SEQ ID NO: 119868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tacaaacttttaaattaggt

SEQ ID NO: 119869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaacttttaaattaggtca

SEQ ID NO: 119870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaattaggtcacaatatt

SEQ ID NO: 119871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaattaggtcacaatattc

SEQ ID NO: 119872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattaggtcacaatattcc

SEQ ID NO: 119873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattaggtcacaatattcct

SEQ ID NO: 119874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtcacaatattcctaaaaa

SEQ ID NO: 119875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctaaaaaccctaagtagact

SEQ ID NO: 119876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaaccctaagtagactata

SEQ ID NO: 119877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtagactataagggcaatg

SEQ ID NO: 119878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taagggcaatgcattataag

SEQ ID NO: 119879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaggctagagttgccgtgt

SEQ ID NO: 119880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gagttgccgtgtatataaca

SEQ ID NO: 119881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccgtgtatataacaatacct

SEQ ID NO: 119882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaccgggcatggtggctca

SEQ ID NO: 119883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acgcctgtaatcccagcact

SEQ ID NO: 119884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taatcccagcactttggaag

SEQ ID NO: 119885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggaaggccgaggcaggtgg

SEQ ID NO: 119886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaaggccgaggcaggtgga

SEQ ID NO: 119887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaggccgaggcaggtggat

SEQ ID NO: 119888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagtcgggagttcgagacca

SEQ ID NO: 119889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gagaccagtctgaccaacat

SEQ ID NO: 119890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
accaacatggagaaaccctg

SEQ ID NO: 119891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctctactaaaaatacaaaa

SEQ ID NO: 119892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tactaaaaatacaaaattag

SEQ ID NO: 119893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaaaaatacaaaattagcc

SEQ ID NO: 119894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaatacaaaattagccagg

SEQ ID NO: 119895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccaggcgtggtggggcatg

SEQ ID NO: 119896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taatcccagctactcaggag

SEQ ID NO: 119897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcaggaggctgaggcagaa

SEQ ID NO: 119898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggaggctgaggcagaagaa

SEQ ID NO: 119899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggcagaagaattgcttgaa

SEQ ID NO: 119900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttgaacctgggaggcggag

SEQ ID NO: 119901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaacctgggaggcggaggtt

SEQ ID NO: 119902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacctgggaggcggaggttg

SEQ ID NO: 119903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaggcggaggttgtggcga

SEQ ID NO: 119904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggcgagccaagattgcgcc

SEQ ID NO: 119905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cgccattgcactccagcctg

SEQ ID NO: 119906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cactccagcctgggcaacaa

SEQ ID NO: 119907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagcctgggcaacaagagtg

SEQ ID NO: 119908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcaacaagagtgaaactcc

SEQ ID NO: 119909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctctcacaaaaaaaataaa

SEQ ID NO: 119910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcacaaaaaaaataaaaaat

SEQ ID NO: 119911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acaaaaaaaataaaaaataa

SEQ ID NO: 119912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatgcttggtctgcaatat

SEQ ID NO: 119913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtctgcaatatttctcatt

SEQ ID NO: 119914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtctgcaatatttctcattt

SEQ ID NO: 119915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caatatttctcatttgaaaa

SEQ ID NO: 119916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcatttgaaaacttttcta

SEQ ID NO: 119917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcatttgaaaacttttctac

SEQ ID NO: 119918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atttgaaaacttttctactc

SEQ ID NO: 119919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaacttttctactcctgg

SEQ ID NO: 119920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaacttttctactcctggt

SEQ ID NO: 119921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctactcctggttcgtgga

SEQ ID NO: 119922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctactcctggttcgtggac

SEQ ID NO: 119923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctactcctggttcgtggact

SEQ ID NO: 119924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tactcctggttcgtggactt

SEQ ID NO: 119925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcctggttcgtggacttgt

SEQ ID NO: 119926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctggttcgtggacttgtcta

SEQ ID NO: 119927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttcgtggacttgtctataa

SEQ ID NO: 119928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gtggacttgtctataacttc

SEQ ID NO: 119929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtctataacttcctctgcca

SEQ ID NO: 119930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctataacttcctctgccat

SEQ ID NO: 119931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taacttcctctgccataatt

SEQ ID NO: 119932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctctgccataattaaagta

SEQ ID NO: 119933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctctgccataattaaagtat

SEQ ID NO: 119934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgccataattaaagtatctc

SEQ ID NO: 119935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccataattaaagtatctctg

SEQ ID NO: 119936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtatctctgggcaccaaa

SEQ ID NO: 119937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgggcaccaaaaacatttac

SEQ ID NO: 119938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcaccaaaaacatttacaa

SEQ ID NO: 119939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaaaatgactgctttcaac

SEQ ID NO: 119940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaaatgactgctttcaact

SEQ ID NO: 119941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctttcaactatgatgtcaat

SEQ ID NO: 119942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaactatgatgtcaataaa

SEQ ID NO: 119943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caactatgatgtcaataaaa

SEQ ID NO: 119944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aactatgatgtcaataaaat

SEQ ID NO: 119945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgatgtcaataaaattcctt

SEQ ID NO: 119946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttatactacaaaaattcta

SEQ ID NO: 119947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atactacaaaaattctatga

SEQ ID NO: 119948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactacaaaaattctatgat

SEQ ID NO: 119949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaaaattctatgattctat

SEQ ID NO: 119950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatgattctattattcctgc

SEQ ID NO: 119951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgattctattattcctgcat

SEQ ID NO: 119952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattattcctgcatggataa

SEQ ID NO: 119953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttattcctgcatggataatt

SEQ ID NO: 119954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcctgcatggataatttac

SEQ ID NO: 119955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgcatggataatttaccag

SEQ ID NO: 119956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catggataatttaccagtaa

SEQ ID NO: 119957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
accagtaattcaagcttttt

SEQ ID NO: 119958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccagtaattcaagcttttta

SEQ ID NO: 119959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagctttttatgtaaggaga

SEQ ID NO: 119960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttatgtaaggagagagatt

SEQ ID NO: 119961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatgtaaggagagagatta

SEQ ID NO: 119962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgtaaggagagagattat

SEQ ID NO: 119963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgtaaggagagagattatc

SEQ ID NO: 119964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtaaggagagagattatca

SEQ ID NO: 119965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcagaaaaactatggggatg

SEQ ID NO: 119966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggggatgcccctccaggaa

SEQ ID NO: 119967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caggaatttcattttcattc

SEQ ID NO: 119968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattttcattcttgtctggg

SEQ ID NO: 119969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attttcattcttgtctgggc

SEQ ID NO: 119970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattcttgtctgggcattc

SEQ ID NO: 119971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattcttgtctgggcattct

SEQ ID NO: 119972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attcttgtctgggcattctg

SEQ ID NO: 119973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgtctgggcattctgcctt

SEQ ID NO: 119974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtctgggcattctgccttta

SEQ ID NO: 119975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctgggcattctgcctttaa

SEQ ID NO: 119976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcattctgcctttaacagc

SEQ ID NO: 119977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcctttaacagctttctct

SEQ ID NO: 119978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctttaacagctttctcttt

SEQ ID NO: 119979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taacagctttctctttgtgt

SEQ ID NO: 119980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacagctttctctttgtgtg

SEQ ID NO: 119981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acagctttctctttgtgtgt

SEQ ID NO: 119982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctctttgtgtgtaatgtcc

SEQ ID NO: 119983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctttgtgtgtaatgtccc

SEQ ID NO: 119984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctttgtgtgtaatgtcccc

SEQ ID NO: 119985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttgtgtgtaatgtccccac

SEQ ID NO: 119986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtgtgtaatgtccccacca

SEQ ID NO: 119987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgtgtaatgtccccaccac

SEQ ID NO: 119988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtgtaatgtccccaccact

SEQ ID NO: 119989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtttcatgaaactaggtat

SEQ ID NO: 119990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtttcatgaaactaggtatc

SEQ ID NO: 119991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgaaactaggtatcccta

SEQ ID NO: 119992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgaaactaggtatccctat

SEQ ID NO: 119993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtatccctatatgtgcctc

SEQ ID NO: 119994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatgtgcctcagaaacacaa

SEQ ID NO: 119995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaaacacaaaacacaacaa

SEQ ID NO: 119996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagttgctggtccatccctt

SEQ ID NO: 119997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctggtccatcccttcatctc

SEQ ID NO: 119998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtccatcccttcatctctgc

SEQ ID NO: 119999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catctctgctgattttagga

SEQ ID NO: 120000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atctctgctgattttaggaa

SEQ ID NO: 120001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgctgattttaggaattcag

SEQ ID NO: 120002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctgattttaggaattcagaa

SEQ ID NO: 120003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attttaggaattcagaaatt

SEQ ID NO: 120004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taggaattcagaaatttaag

SEQ ID NO: 120005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggaattcagaaatttaaga

SEQ ID NO: 120006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaattcagaaatttaagaa

SEQ ID NO: 120007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaaatttaagaatatgaga

SEQ ID NO: 120008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagaatatgagaagttttga

SEQ ID NO: 120009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaatatgagaagttttgat

SEQ ID NO: 120010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgatttggggaagaggaatt

SEQ ID NO: 120011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatttggggaagaggaatta

SEQ ID NO: 120012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atttggggaagaggaattag

SEQ ID NO: 120013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggggaagaggaattagtatg

SEQ ID NO: 120014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggaagaggaattagtatgc

SEQ ID NO: 120015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtatgcataggggtatactt

SEQ ID NO: 120016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagtaattcactaatgaaat

SEQ ID NO: 120017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtaattcactaatgaaatt

SEQ ID NO: 120018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtaattcactaatgaaattt

SEQ ID NO: 120019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actaatgaaattttgtaaat

SEQ ID NO: 120020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgaaattttgtaaatgata

SEQ ID NO: 120021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaaatgataatcacttcc

SEQ ID NO: 120022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaaatgataatcacttcct

SEQ ID NO: 120023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaatgataatcacttccta

SEQ ID NO: 120024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctattatttatttaactat

SEQ ID NO: 120025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctattatttatttaactatg

SEQ ID NO: 120026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttatttatttaactatgccc

SEQ ID NO: 120027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttaactatgcccact

SEQ ID NO: 120028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttaactatgcccactatt

SEQ ID NO: 120029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaactatgcccactatta

SEQ ID NO: 120030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactatgcccactattatcc

SEQ ID NO: 120031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actatgcccactattatcct

SEQ ID NO: 120032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgcccactattatcctagac

SEQ ID NO: 120033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttatcctagacacattgaat

SEQ ID NO: 120034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcctagacacattgaattga

SEQ ID NO: 120035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gacacattgaattgagctct

SEQ ID NO: 120036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattgagctcttagaatttt

SEQ ID NO: 120037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agctcttagaattttgtctg

SEQ ID NO: 120038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttagaattttgtctgtaaat

SEQ ID NO: 120039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaattttgtctgtaaataa

SEQ ID NO: 120040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaattttgtctgtaaataag

SEQ ID NO: 120041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtctgtaaataagaattag

SEQ ID NO: 120042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtctgtaaataagaattaga

SEQ ID NO: 120043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctgtaaataagaattagaa

SEQ ID NO: 120044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaataagaattagaactat

SEQ ID NO: 120045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaactatattttatgaggtc

SEQ ID NO: 120046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tattttatgaggtcactttt

SEQ ID NO: 120047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgaggtcacttttaactt

SEQ ID NO: 120048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgaggtcacttttaactta

SEQ ID NO: 120049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgaggtcacttttaacttag

SEQ ID NO: 120050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaacttagtcatcaatgat

SEQ ID NO: 120051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacttagtcatcaatgatt

SEQ ID NO: 120052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacttagtcatcaatgattc

SEQ ID NO: 120053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acttagtcatcaatgattcc

SEQ ID NO: 120054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtcatcaatgattccatgt

SEQ ID NO: 120055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtcatcaatgattccatgtt

SEQ ID NO: 120056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catgtttgtaaacacattct

SEQ ID NO: 120057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaaacacattctctgtcaa

SEQ ID NO: 120058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaacacattctctgtcaat

SEQ ID NO: 120059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgtcaatcatcttgccca

SEQ ID NO: 120060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtcaatcatcttgcccact

SEQ ID NO: 120061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcaatcatcttgcccactgg

SEQ ID NO: 120062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcccactggtgatcaccagg

SEQ ID NO: 120063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccactggtgatcaccaggg

SEQ ID NO: 120064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtgatcaccagggaaaaggc

SEQ ID NO: 120065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcaaagctcaaaaagaaca

SEQ ID NO: 120066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaagctcaaaaagaacattt

SEQ ID NO: 120067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaaagaacattttaagtat

SEQ ID NO: 120068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagtatatgtattacatca

SEQ ID NO: 120069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagtatatgtattacatcag

SEQ ID NO: 120070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtatatgtattacatcagc

SEQ ID NO: 120071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catcagcggcttagttgcat

SEQ ID NO: 120072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agttgcatgtgtattaaaat

SEQ ID NO: 120073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttgcatgtgtattaaaatg

SEQ ID NO: 120074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catgtgtattaaaatgtgaa

SEQ ID NO: 120075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgtgaagggcagtatat

SEQ ID NO: 120076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaatcaaaagatggttata

SEQ ID NO: 120077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcaaaagatggttataact

SEQ ID NO: 120078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taactaagagtaagaaacag

SEQ ID NO: 120079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agagtaagaaacaggaatta

SEQ ID NO: 120080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcaactacaaatataaag

SEQ ID NO: 120081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caactacaaatataaagcga

SEQ ID NO: 120082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aactacaaatataaagcgaa

SEQ ID NO: 120083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaatataaagcgaatgcta

SEQ ID NO: 120084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttgacggtgacttttttt

SEQ ID NO: 120085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgacggtgactttttttata

SEQ ID NO: 120086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacggtgactttttttataa

SEQ ID NO: 120087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acggtgactttttttataat

SEQ ID NO: 120088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttataatatttttaaaa

SEQ ID NO: 120089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttataatatttttaaaac

SEQ ID NO: 120090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttataatatttttaaaaca

SEQ ID NO: 120091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttataatatttttaaaacat

SEQ ID NO: 120092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tataatatttttaaaacatt

SEQ ID NO: 120093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataatatttttaaaacatta

SEQ ID NO: 120094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatatttttaaaacattat

SEQ ID NO: 120095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaacattattttaacaa

SEQ ID NO: 120096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaacattattttaacaaa

SEQ ID NO: 120097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaacattattttaacaaaa

SEQ ID NO: 120098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaacattattttaacaaaaa

SEQ ID NO: 120099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaacaaaaaaagctttt

SEQ ID NO: 120100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacaaaaaaagctttttca

SEQ ID NO: 120101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacaaaaaaagctttttcag

SEQ ID NO: 120102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaaaaaaagctttttcaga

SEQ ID NO: 120103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttcagagtgctaagagtaa

SEQ ID NO: 120104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcagagtgctaagagtaat

SEQ ID NO: 120105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagagtgctaagagtaatt

SEQ ID NO: 120106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagagtgctaagagtaattt

SEQ ID NO: 120107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agagtgctaagagtaatttg

SEQ ID NO: 120108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agagtaatttgcctgctctc

SEQ ID NO: 120109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcctgctctctatatataag

SEQ ID NO: 120110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctgctctctatatataagc

SEQ ID NO: 120111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctctctatatataagcacag

SEQ ID NO: 120112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctatatataagcacagacg

SEQ ID NO: 120113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatatataagcacagacgca

SEQ ID NO: 120114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatataagcacagacgcaca

SEQ ID NO: 120115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctaagtagacacttaagac

SEQ ID NO: 120116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctaagtagacacttaagaca

SEQ ID NO: 120117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtagacacttaagacattc

SEQ ID NO: 120118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagacattcatatctaagtt

SEQ ID NO: 120119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agacattcatatctaagttt

SEQ ID NO: 120120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatctaagttttaaaaaaa

SEQ ID NO: 120121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agttttaaaaaaatctgatt

SEQ ID NO: 120122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaaaatctgatttggcg

SEQ ID NO: 120123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaaatctgatttggcga

SEQ ID NO: 120124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaatctgatttggcgac

SEQ ID NO: 120125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atttggcgacacaaaggctt

SEQ ID NO: 120126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcgacacaaaggcttccaa

SEQ ID NO: 120127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcgacacaaaggcttccaag

SEQ ID NO: 120128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaagggaagaatttaacaa

SEQ ID NO: 120129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caagggaagaatttaacaaa

SEQ ID NO: 120130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacaaaatatcttgaagtct

SEQ ID NO: 120131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaaaatatcttgaagtctt

SEQ ID NO: 120132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaagtcttgaagcatgaaaa

SEQ ID NO: 120133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagtcttgaagcatgaaaag

SEQ ID NO: 120134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaagcatgaaaagcctaaaa

SEQ ID NO: 120135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagcatgaaaagcctaaaaa

SEQ ID NO: 120136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaagaagaataatacaaaa

SEQ ID NO: 120137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccttataaagtttatcaac

SEQ ID NO: 120138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttataaagtttatcaacc

SEQ ID NO: 120139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttataaagtttatcaacca

SEQ ID NO: 120140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataaagtttatcaaccacac

SEQ ID NO: 120141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaagtttatcaaccacaca

SEQ ID NO: 120142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcaaccacacaattacttt

SEQ ID NO: 120143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaaccacacaattacttta

SEQ ID NO: 120144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttatggtttatataaaat

SEQ ID NO: 120145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatggtttatataaaattat

SEQ ID NO: 120146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atggtttatataaaattatg

SEQ ID NO: 120147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggtttatataaaattatga

SEQ ID NO: 120148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atataaaattatgaactgca

SEQ ID NO: 120149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tataaaattatgaactgcat

SEQ ID NO: 120150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgaactgcatacaacttatc

SEQ ID NO: 120151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catacaacttatcatgaaaa

SEQ ID NO: 120152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atcatgaaaaaattgcttcc

SEQ ID NO: 120153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcatgaaaaaattgcttcct

SEQ ID NO: 120154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttcctgcaactgagctgag

SEQ ID NO: 120155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctgcaactgagctgaggaa

SEQ ID NO: 120156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgcaactgagctgaggaat

SEQ ID NO: 120157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caactgagctgaggaattta

SEQ ID NO: 120158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agctgaggaatttagggatg

SEQ ID NO: 120159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggaatttagggatgatatg

SEQ ID NO: 120160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agggatgatatgtgtcaaag

SEQ ID NO: 120161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gggatgatatgtgtcaaagg

SEQ ID NO: 120162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttttcaagcaaaagatgt

SEQ ID NO: 120163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttcaagcaaaagatgtg

SEQ ID NO: 120164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttcaagcaaaagatgtggg

SEQ ID NO: 120165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcaagcaaaagatgtgggt

SEQ ID NO: 120166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaagcaaaagatgtgggtc

SEQ ID NO: 120167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caagcaaaagatgtgggtca

SEQ ID NO: 120168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagcaaaagatgtgggtcat

SEQ ID NO: 120169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattgcaatatcttcatggc

SEQ ID NO: 120170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgcaatatcttcatggctc

SEQ ID NO: 120171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caatatcttcatggctctct

SEQ ID NO: 120172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catggctctcttgccaaaag

SEQ ID NO: 120173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atggctctcttgccaaaaga

SEQ ID NO: 120174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcttgccaaaagactgatgt

SEQ ID NO: 120175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgccaaaagactgatgtat

SEQ ID NO: 120176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gccaaaagactgatgtatat

SEQ ID NO: 120177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccaaaagactgatgtatatt

SEQ ID NO: 120178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgtatatttaatcacttta

SEQ ID NO: 120179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatcactttatctaatggat

SEQ ID NO: 120180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcactttatctaatggatg

SEQ ID NO: 120181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatctaatggatgtgatttc

SEQ ID NO: 120182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctaatggatgtgatttct

SEQ ID NO: 120183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctaatggatgtgatttcta

SEQ ID NO: 120184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atggatgtgatttctaaagt

SEQ ID NO: 120185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaaagtcacagttagccat

SEQ ID NO: 120186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaagtcacagttagccatt

SEQ ID NO: 120187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtcacagttagccattag

SEQ ID NO: 120188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccattaggaaagctcttgc

SEQ ID NO: 120189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaaagctcttgctctggtt

SEQ ID NO: 120190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgctctggttcagctgagc

SEQ ID NO: 120191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctctggttcagctgagcac

SEQ ID NO: 120192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctctggttcagctgagcact

SEQ ID NO: 120193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tggttcagctgagcactctg

SEQ ID NO: 120194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttcagctgagcactctgat

SEQ ID NO: 120195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agctgagcactctgattaca

SEQ ID NO: 120196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agcactctgattacatttcc

SEQ ID NO: 120197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgattacatttcctgacttt

SEQ ID NO: 120198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attacatttcctgactttgt

SEQ ID NO: 120199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catttcctgactttgtggtt

SEQ ID NO: 120200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgactttgtggtttcaga

SEQ ID NO: 120201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgactttgtggtttcagag

SEQ ID NO: 120202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actttgtggtttcagagaag

SEQ ID NO: 120203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtggtttcagagaagcaga

SEQ ID NO: 120204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtggtttcagagaagcagag

SEQ ID NO: 120205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggtttcagagaagcagagc

SEQ ID NO: 120206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagagaagcagagctggtgg

SEQ ID NO: 120207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agagaagcagagctggtgga

SEQ ID NO: 120208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtggagaattccctggctgg

SEQ ID NO: 120209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctggctggattcatcagtc

SEQ ID NO: 120210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctggattcatcagtctttg

SEQ ID NO: 120211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gattcatcagtctttgctat

SEQ ID NO: 120212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcagtctttgctatggaca

SEQ ID NO: 120213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgctatggacaagagaatac

SEQ ID NO: 120214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctatggacaagagaataca

SEQ ID NO: 120215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctatggacaagagaatacag

SEQ ID NO: 120216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggacaagagaatacagtaa

SEQ ID NO: 120217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtcttgggggttgggtagat

SEQ ID NO: 120218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gggggttgggtagattcact

SEQ ID NO: 120219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggggttgggtagattcacta

SEQ ID NO: 120220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggtagattcactacatccaa

SEQ ID NO: 120221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actacatccaagtctttaga

SEQ ID NO: 120222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catccaagtctttagagcca

SEQ ID NO: 120223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagagccaagtgcccatatg

SEQ ID NO: 120224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agagccaagtgcccatatgg

SEQ ID NO: 120225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagccaagtgcccatatggc

SEQ ID NO: 120226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actttaattactatagaaca

SEQ ID NO: 120227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taattactatagaacagatt

SEQ ID NO: 120228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattactatagaacagattt

SEQ ID NO: 120229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attactatagaacagatttt

SEQ ID NO: 120230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctatagaacagatttttttt

SEQ ID NO: 120231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagaacagattttttttccc

SEQ ID NO: 120232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttccccaaattcttacc

SEQ ID NO: 120233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttccccaaattcttaccc

SEQ ID NO: 120234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttccccaaattcttaccct

SEQ ID NO: 120235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccccaaattcttaccctt

SEQ ID NO: 120236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccccaaattcttacccttc

SEQ ID NO: 120237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccccaaattcttacccttct

SEQ ID NO: 120238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccaaattcttacccttctt

SEQ ID NO: 120239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttacccttcttgattagatt

SEQ ID NO: 120240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acccttcttgattagattgg

SEQ ID NO: 120241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccttcttgattagattgga

SEQ ID NO: 120242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttgattagattggaaacaa

SEQ ID NO: 120243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgattagattggaaacaaa

SEQ ID NO: 120244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gattagattggaaacaaatc

SEQ ID NO: 120245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attagattggaaacaaatct

SEQ ID NO: 120246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gattggaaacaaatctcatt

SEQ ID NO: 120247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaacaaatctcattatgga

SEQ ID NO: 120248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attatggagttttaaataat

SEQ ID NO: 120249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggagttttaaataattacc

SEQ ID NO: 120250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaataattaccatgaagct

SEQ ID NO: 120251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaataattaccatgaagctc

SEQ ID NO: 120252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataattaccatgaagctca

SEQ ID NO: 120253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccatgaagctcatcatcatc

SEQ ID NO: 120254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atcatcatcaacctgatacc

SEQ ID NO: 120255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ataccatctaagaatatgtt

SEQ ID NO: 120256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaatatgtttatgtgcaaa

SEQ ID NO: 120257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgtgcaaaataatgcaatg

SEQ ID NO: 120258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtgcaaaataatgcaatga

SEQ ID NO: 120259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaaaaatttaaattcaagt

SEQ ID NO: 120260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaaatttaaattcaagta

SEQ ID NO: 120261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattcaagtatagtgtgat

SEQ ID NO: 120262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattcaagtatagtgtgata

SEQ ID NO: 120263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagtatagtgtgatatgttt

SEQ ID NO: 120264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actgttgtaagatacagtaa

SEQ ID NO: 120265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgttgtaagatacagtaaa

SEQ ID NO: 120266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgtaagatacagtaaaaaa

SEQ ID NO: 120267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagatacagtaaaaaatgt

SEQ ID NO: 120268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaatatatcacaaatagact

SEQ ID NO: 120269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctattgtcttcattctat

SEQ ID NO: 120270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctattgtcttcattctatg

SEQ ID NO: 120271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgtcttcattctatggcgt

SEQ ID NO: 120272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttcattctatggcgtttc

SEQ ID NO: 120273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattctatggcgtttcttaa

SEQ ID NO: 120274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attctatggcgtttcttaag

SEQ ID NO: 120275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatggcgtttcttaagaaac

SEQ ID NO: 120276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggcgtttcttaagaaacac

SEQ ID NO: 120277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttaagaaacacgtacaatg

SEQ ID NO: 120278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaagaaacacgtacaatgt

SEQ ID NO: 120279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagaaacacgtacaatgtta

SEQ ID NO: 120280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaaacacgtacaatgttaa

SEQ ID NO: 120281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatagtacttgacatctca

SEQ ID NO: 120282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacatctcaaaaaaaataag

SEQ ID NO: 120283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acatctcaaaaaaaataagc

SEQ ID NO: 120284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaaaaaataagccctaaac

SEQ ID NO: 120285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacccgtaaaatggggagaa

SEQ ID NO: 120286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaagttggtatattggtaa

SEQ ID NO: 120287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtatattggtaagtgtgcct

SEQ ID NO: 120288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtaagtgtgcctattataat

SEQ ID NO: 120289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttataatgtgaatgacagta

SEQ ID NO: 120290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatgtgaatgacagtaaga

SEQ ID NO: 120291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acacggccctacttttaaca

SEQ ID NO: 120292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacggccctacttttaacag

SEQ ID NO: 120293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttttaacagcctgacagaa

SEQ ID NO: 120294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaacagcctgacagaaaat

SEQ ID NO: 120295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacagcctgacagaaaatt

SEQ ID NO: 120296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacagcctgacagaaaattt

SEQ ID NO: 120297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acagcctgacagaaaattta

SEQ ID NO: 120298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acagaaaatttacagtagat

SEQ ID NO: 120299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acagtagataaatctatact

SEQ ID NO: 120300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagtagataaatctatacta

SEQ ID NO: 120301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tactactcatggatttatct

SEQ ID NO: 120302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcatggatttatctgactt

SEQ ID NO: 120303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atggatttatctgacttatg

SEQ ID NO: 120304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctgacttatggatgattc

SEQ ID NO: 120305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgacttatggatgattcc

SEQ ID NO: 120306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acttatggatgattcccctt

SEQ ID NO: 120307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atggatgattcccctttaaa

SEQ ID NO: 120308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggatgattcccctttaaag

SEQ ID NO: 120309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccctttaaagactgttctat

SEQ ID NO: 120310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaagactgttctattcaat

SEQ ID NO: 120311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagactgttctattcaata

SEQ ID NO: 120312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagactgttctattcaataa

SEQ ID NO: 120313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttctattcaataaagtttta

SEQ ID NO: 120314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattcaataaagttttacat

SEQ ID NO: 120315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttcaataaagttttacatgc

SEQ ID NO: 120316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aataaagttttacatgcttg

SEQ ID NO: 120317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacatgcttgttgtatgcat

SEQ ID NO: 120318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatgcttgttgtatgcatt

SEQ ID NO: 120319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catgcttgttgtatgcattc

SEQ ID NO: 120320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttgtatgcattcctttgct

SEQ ID NO: 120321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgtatgcattcctttgcta

SEQ ID NO: 120322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatgcattcctttgctacaa

SEQ ID NO: 120323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttgctacaagaccagaaa

SEQ ID NO: 120324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgctacaagaccagaaataa

SEQ ID NO: 120325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctacaagaccagaaataaa

SEQ ID NO: 120326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctacaagaccagaaataaag

SEQ ID NO: 120327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caagaccagaaataaagcat

SEQ ID NO: 120328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacaatgtgatctaaataac

SEQ ID NO: 120329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aataacaagttaaaaagata

SEQ ID NO: 120330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaagataaaacaccatggt

SEQ ID NO: 120331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgatggtgataaatgtaat

SEQ ID NO: 120332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caataaaagcagactgcagt

SEQ ID NO: 120333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagtaagactgaaactaaga

SEQ ID NO: 120334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaactaagaaaccaaataag

SEQ ID NO: 120335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaaaccaaataaggcatta

SEQ ID NO: 120336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaaggaccttacattctgt

SEQ ID NO: 120337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acattctgtactgaagtata

SEQ ID NO: 120338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cattctgtactgaagtatag

SEQ ID NO: 120339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtactgaagtatagaaata

SEQ ID NO: 120340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tactgaagtatagaaatatt

SEQ ID NO: 120341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagtatagaaatattattta

SEQ ID NO: 120342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaggaaagcaagcttcaa

SEQ ID NO: 120343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggaaagcaagcttcaatca

SEQ ID NO: 120344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaaagcaagcttcaatcac

SEQ ID NO: 120345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caatcacaaaacatcaatca

SEQ ID NO: 120346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatcacaaaacatcaatcat

SEQ ID NO: 120347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attaaagtacatcttgcttt

SEQ ID NO: 120348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtacatcttgcttttcgt

SEQ ID NO: 120349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcttttcgtatatgcacctt

SEQ ID NO: 120350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttttcgtatatgcaccttc

SEQ ID NO: 120351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcgtatatgcaccttcatt

SEQ ID NO: 120352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcgtatatgcaccttcatta

SEQ ID NO: 120353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgtatatgcaccttcattag

SEQ ID NO: 120354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gtatatgcaccttcattaga

SEQ ID NO: 120355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattagactcttaatgaact

SEQ ID NO: 120356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attagactcttaatgaactg

SEQ ID NO: 120357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gactcttaatgaactgatta

SEQ ID NO: 120358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaatgaactgattaaaaat

SEQ ID NO: 120359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatgaactgattaaaaatgt

SEQ ID NO: 120360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgaactgattaaaaatgtt

SEQ ID NO: 120361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attaaaaatgttttctccaa

SEQ ID NO: 120362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatgttttctccaatggg

SEQ ID NO: 120363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctccaatgggttaattttt

SEQ ID NO: 120364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctccaatgggttaatttttt

SEQ ID NO: 120365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccaatgggttaattttttc

SEQ ID NO: 120366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caatgggttaattttttctt

SEQ ID NO: 120367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttttcttagttgcagta

SEQ ID NO: 120368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcttagttgcagtaacat

SEQ ID NO: 120369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttagttgcagtaacatt

SEQ ID NO: 120370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttagttgcagtaacattg

SEQ ID NO: 120371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttagttgcagtaacattgt

SEQ ID NO: 120372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttagttgcagtaacattgtg

SEQ ID NO: 120373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agttgcagtaacattgtggg

SEQ ID NO: 120374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttgcagtaacattgtggga

SEQ ID NO: 120375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagtaacattgtgggatatt

SEQ ID NO: 120376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgggatattcttctatatac

SEQ ID NO: 120377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctatatactgatcaagat

SEQ ID NO: 120378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctatatactgatcaagatac

SEQ ID NO: 120379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatatactgatcaagatact

SEQ ID NO: 120380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatactgatcaagatacttt

SEQ ID NO: 120381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atcaagatacttttcctaca

SEQ ID NO: 120382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcctacacacagcataaga

SEQ ID NO: 120383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctacacacagcataagaa

SEQ ID NO: 120384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctacacacagcataagaag

SEQ ID NO: 120385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctacacacagcataagaaga

SEQ ID NO: 120386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacacagcataagaagatat

SEQ ID NO: 120387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agacttccacgttaatcaaa

SEQ ID NO: 120388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccacgttaatcaaactgaaa

SEQ ID NO: 120389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacgttaatcaaactgaaaa

SEQ ID NO: 120390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcaaactgaaaagtaagac

SEQ ID NO: 120391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaagtaagacaaggaattc

SEQ ID NO: 120392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaatcagagcctattttag

SEQ ID NO: 120393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttagaactatgagcattc

SEQ ID NO: 120394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagaactatgagcattcaac

SEQ ID NO: 120395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaactatgagcattcaact

SEQ ID NO: 120396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaactatgagcattcaactg

SEQ ID NO: 120397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgagcattcaactgaaaacg

SEQ ID NO: 120398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aactgaaaacgggtctccag

SEQ ID NO: 120399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaacgggtctccagatttc

SEQ ID NO: 120400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagatttctgtgctgctcca

SEQ ID NO: 120401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtgctgctccattctgtt

SEQ ID NO: 120402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtgctgctccattctgttg

SEQ ID NO: 120403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgctgctccattctgttgcc

SEQ ID NO: 120404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctccattctgttgccaccaa

SEQ ID NO: 120405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cattctgttgccaccaacaa

SEQ ID NO: 120406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttgccaccaacaattgat

SEQ ID NO: 120407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgccaccaacaattgataa

SEQ ID NO: 120408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccaccaacaattgataattg

SEQ ID NO: 120409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataattggtatcatttttgt

SEQ ID NO: 120410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtatcatttttgtgcaagtg

SEQ ID NO: 120411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtgcaagtgagatgtgcc

SEQ ID NO: 120412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgcaagtgagatgtgcct

SEQ ID NO: 120413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgcaagtgagatgtgcctt

SEQ ID NO: 120414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgcaagtgagatgtgccttg

SEQ ID NO: 120415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttagtgctttttaacttga

SEQ ID NO: 120416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttagtgctttttaacttgag

SEQ ID NO: 120417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgctttttaacttgagtgt

SEQ ID NO: 120418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttaacttgagtgtttgaag

SEQ ID NO: 120419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaacttgagtgtttgaagt

SEQ ID NO: 120420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacttgagtgtttgaagtt

SEQ ID NO: 120421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacttgagtgtttgaagttg

SEQ ID NO: 120422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acttgagtgtttgaagttgt

SEQ ID NO: 120423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagtgtttgaagttgttcaa

SEQ ID NO: 120424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtgtttgaagttgttcaaa

SEQ ID NO: 120425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaagttgttcaaataataaa

SEQ ID NO: 120426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagttgttcaaataataaac

SEQ ID NO: 120427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttcaaataataaactgtttt

SEQ ID NO: 120428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaataataaactgttttctc

SEQ ID NO: 120429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttctctaaaccaagattt

SEQ ID NO: 120430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctctaaaccaagatttaaa

SEQ ID NO: 120431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctaaaccaagatttaaaa

SEQ ID NO: 120432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctaaaccaagatttaaaag

SEQ ID NO: 120433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taaaccaagatttaaaagtt

SEQ ID NO: 120434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaccaagatttaaaagttcc

SEQ ID NO: 120435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaagttccaggatcgatat

SEQ ID NO: 120436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagttccaggatcgatatc

SEQ ID NO: 120437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caggatcgatatctttccat

SEQ ID NO: 120438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccattgtatctgttttttt

SEQ ID NO: 120439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccattgtatctgtttttttt

SEQ ID NO: 120440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattgtatctgttttttttt

SEQ ID NO: 120441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatctgttttttttttaatt

SEQ ID NO: 120442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttttttttaatttctttc

SEQ ID NO: 120443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttaatttctttctta

SEQ ID NO: 120444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttaatttctttcttat

SEQ ID NO: 120445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttaatttctttcttatt

SEQ ID NO: 120446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaatttctttcttatta

SEQ ID NO: 120447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaatttctttcttattaa

SEQ ID NO: 120448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaatttctttcttattaaa

SEQ ID NO: 120449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatttctttcttattaaaa

SEQ ID NO: 120450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttctttcttattaaaac

SEQ ID NO: 120451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttctttcttattaaaaca

SEQ ID NO: 120452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcttattaaaacatcac

SEQ ID NO: 120453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcttattaaaacatcaca

SEQ ID NO: 120454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttattaaaacatcacaaa

SEQ ID NO: 120455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttattaaaacatcacaaat

SEQ ID NO: 120456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttattaaaacatcacaaatt

SEQ ID NO: 120457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attaaaacatcacaaatttc

SEQ ID NO: 120458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaaacatcacaaatttct

SEQ ID NO: 120459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaacatcacaaatttctttt

SEQ ID NO: 120460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttgaaaaaagatctgtg

SEQ ID NO: 120461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttgaaaaaagatctgtgc

SEQ ID NO: 120462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgaaaaaagatctgtgctt

SEQ ID NO: 120463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaaaaaagatctgtgcttt

SEQ ID NO: 120464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaaaagatctgtgctttc

SEQ ID NO: 120465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaaagatctgtgctttct

SEQ ID NO: 120466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgctttctgggcgtggtggc

SEQ ID NO: 120467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctgggcgtggtggctaatg

SEQ ID NO: 120468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgggcgtggtggctaatgt

SEQ ID NO: 120469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgggcgtggtggctaatgtc

SEQ ID NO: 120470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcgtggtggctaatgtctg

SEQ ID NO: 120471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgtctgtaatcccagcact

SEQ ID NO: 120472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taatcccagcactttgggag

SEQ ID NO: 120473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgggaggccgaagtgggcag

SEQ ID NO: 120474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggaggccgaagtgggcaga

SEQ ID NO: 120475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaggccgaagtgggcagat

SEQ ID NO: 120476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaggtcaggagttcaagtcc

SEQ ID NO: 120477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggtcaggagttcaagtcca

SEQ ID NO: 120478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagtccagcctgaccaacat

SEQ ID NO: 120479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
accaacatgatgaaacccct

SEQ ID NO: 120480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccttcaaaaatacaaaaat

SEQ ID NO: 120481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttcaaaaatacaaaaata

SEQ ID NO: 120482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaaaatacaaaaatagtga

SEQ ID NO: 120483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaatacaaaaatagtgag

SEQ ID NO: 120484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttccaaaaaaaaaaaaaag

SEQ ID NO: 120485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaaaaaaaaaaaaaagaga

SEQ ID NO: 120486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaaaaaaaaaaaaagagaa

SEQ ID NO: 120487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgctacaaaaaaatgcctta

SEQ ID NO: 120488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaaaaaatgccttaaaaca

SEQ ID NO: 120489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaacatttagttgcctaac

SEQ ID NO: 120490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaacatttagttgcctaaca

SEQ ID NO: 120491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agttgcctaacaccaagcaa

SEQ ID NO: 120492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttgcctaacaccaagcaag

SEQ ID NO: 120493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctaacaccaagcaagtttg

SEQ ID NO: 120494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acaccaagcaagtttgaata

SEQ ID NO: 120495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaataaattatgtaatattc

SEQ ID NO: 120496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aataaattatgtaatattca

SEQ ID NO: 120497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtaatattcattcaatgaa

SEQ ID NO: 120498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attcaatgaacaagagaccc

SEQ ID NO: 120499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgaacaagagaccctttg

SEQ ID NO: 120500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtctgcaataggaaatttg

SEQ ID NO: 120501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtctgcaataggaaatttga

SEQ ID NO: 120502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctgcaataggaaatttgat

SEQ ID NO: 120503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caataggaaatttgataatc

SEQ ID NO: 120504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gataatcttcccatgactaa

SEQ ID NO: 120505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataatcttcccatgactaaa

SEQ ID NO: 120506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccatgactaaaaaaaaatt

SEQ ID NO: 120507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccatgactaaaaaaaaatta

SEQ ID NO: 120508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaaaaaattataatctaca

SEQ ID NO: 120509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatctacagctccccacta

SEQ ID NO: 120510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagctccccactatgtacag

SEQ ID NO: 120511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cccactatgtacagaataac

SEQ ID NO: 120512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtacagaataacctgtcat

SEQ ID NO: 120513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcatgtctttggtctgtcat

SEQ ID NO: 120514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggtctgtcatagaaggttt

SEQ ID NO: 120515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtctgtcatagaaggtttt

SEQ ID NO: 120516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtctgtcatagaaggtttta

SEQ ID NO: 120517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcatagaaggttttactaac

SEQ ID NO: 120518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tactaacctgatgctgacag

SEQ ID NO: 120519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actaacctgatgctgacagc

SEQ ID NO: 120520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaacctgatgctgacagcc

SEQ ID NO: 120521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acctgatgctgacagcctct

SEQ ID NO: 120522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgctgacagcctcttctgt

SEQ ID NO: 120523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acagcctcttctgtttccct

SEQ ID NO: 120524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttctgtttccctatttgcag

SEQ ID NO: 120525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgtttccctatttgcagtc

SEQ ID NO: 120526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtttccctatttgcagtct

SEQ ID NO: 120527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttccctatttgcagtctac

SEQ ID NO: 120528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctatttgcagtctacatt

SEQ ID NO: 120529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctatttgcagtctacattc

SEQ ID NO: 120530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttgcagtctacattccagc

SEQ ID NO: 120531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcagtctacattccagctac

SEQ ID NO: 120532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagtctacattccagctaca

SEQ ID NO: 120533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cattccagctacattattct

SEQ ID NO: 120534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagctacattattctacgtt

SEQ ID NO: 120535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cattattctacgtttaattt

SEQ ID NO: 120536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctacgtttaatttcccca

SEQ ID NO: 120537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacgtttaatttccccaaag

SEQ ID NO: 120538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cgtttaatttccccaaaggt

SEQ ID NO: 120539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttccccaaaggtcagct

SEQ ID NO: 120540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttccccaaaggtcagcta

SEQ ID NO: 120541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccccaaaggtcagctagata

SEQ ID NO: 120542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccaaaggtcagctagataa

SEQ ID NO: 120543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gataatttctgcatcctcat

SEQ ID NO: 120544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgcatcctcataatgttcc

SEQ ID NO: 120545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcatcctcataatgttccc

SEQ ID NO: 120546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catcctcataatgttccctt

SEQ ID NO: 120547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataatgttccctttatctga

SEQ ID NO: 120548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctttatctgaacagtttca

SEQ ID NO: 120549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatctgaacagtttcaacta

SEQ ID NO: 120550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctgaacagtttcaactat

SEQ ID NO: 120551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgaacagtttcaactatc

SEQ ID NO: 120552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacagtttcaactatcctga

SEQ ID NO: 120553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caactatcctgatcacctga

SEQ ID NO: 120554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aactatcctgatcacctgat

SEQ ID NO: 120555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcctgatcacctgattactt

SEQ ID NO: 120556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atcacctgattacttgcttt

SEQ ID NO: 120557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attacttgctttgtaatatt

SEQ ID NO: 120558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttgctttgtaatatttggc

SEQ ID NO: 120559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctttgtaatatttggctca

SEQ ID NO: 120560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttgtaatatttggctcaa

SEQ ID NO: 120561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtaatatttggctcaatac

SEQ ID NO: 120562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaatatttggctcaatacc

SEQ ID NO: 120563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatatttggctcaatacct

SEQ ID NO: 120564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggctcaatacctcttgtatg

SEQ ID NO: 120565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctcaatacctcttgtatga

SEQ ID NO: 120566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatacctcttgtatgaaaag

SEQ ID NO: 120567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgtatgaaaagatctgact

SEQ ID NO: 120568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtatgaaaagatctgacttc

SEQ ID NO: 120569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatgaaaagatctgacttcg

SEQ ID NO: 120570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acttcgcctccttccttccc

SEQ ID NO: 120571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cgcctccttccttccctcaa

SEQ ID NO: 120572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gcctccttccttccctcaaa

SEQ ID NO: 120573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttccttccctcaaatataa

SEQ ID NO: 120574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttccctcaaatataaatt

SEQ ID NO: 120575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttccctcaaatataaattc

SEQ ID NO: 120576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctcaaatataaattcaac

SEQ ID NO: 120577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctcaaatataaattcaacc

SEQ ID NO: 120578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaatataaattcaacccttc

SEQ ID NO: 120579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacccttcatcagcttctct

SEQ ID NO: 120580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catcagcttctctttctccc

SEQ ID NO: 120581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcagcttctctttctccca

SEQ ID NO: 120582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctctttctcccatatctcca

SEQ ID NO: 120583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctttctcccatatctccag

SEQ ID NO: 120584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttctcccatatctccagtc

SEQ ID NO: 120585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctcccatatctccagtctg

SEQ ID NO: 120586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcccatatctccagtctgc

SEQ ID NO: 120587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcccatatctccagtctgct

SEQ ID NO: 120588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccatatctccagtctgcttt

SEQ ID NO: 120589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagtctgctttgagctgcca

SEQ ID NO: 120590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctttgagctgccagcagtcc

SEQ ID NO: 120591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgagctgccagcagtcccct

SEQ ID NO: 120592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagctgccagcagtccccta

SEQ ID NO: 120593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agctgccagcagtcccctaa

SEQ ID NO: 120594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccagcagtcccctaaatgcg

SEQ ID NO: 120595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatgcggatttttatcctac

SEQ ID NO: 120596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatcctacttctacagtgc

SEQ ID NO: 120597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcctacttctacagtgct

SEQ ID NO: 120598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcctacttctacagtgctt

SEQ ID NO: 120599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcctacttctacagtgcttt

SEQ ID NO: 120600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttctacagtgctttatttc

SEQ ID NO: 120601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctacagtgctttatttcttt

SEQ ID NO: 120602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacagtgctttatttctttc

SEQ ID NO: 120603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagtgctttatttctttcat

SEQ ID NO: 120604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatttctttcatcacgcctg

SEQ ID NO: 120605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttctttcatcacgcctgt

SEQ ID NO: 120606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttctttcatcacgcctgtc

SEQ ID NO: 120607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcatcacgcctgtctcc

SEQ ID NO: 120608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcatcacgcctgtctcct

SEQ ID NO: 120609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcatcacgcctgtctccttc

SEQ ID NO: 120610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catcacgcctgtctccttca

SEQ ID NO: 120611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcacgcctgtctccttcaa

SEQ ID NO: 120612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctccttcaactagattcca

SEQ ID NO: 120613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttcaactagattccaaact

SEQ ID NO: 120614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caactagattccaaacttca

SEQ ID NO: 120615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aactagattccaaacttcat

SEQ ID NO: 120616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gattccaaacttcatagaca

SEQ ID NO: 120617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaacttcatagacaggaaa

SEQ ID NO: 120618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catagacaggaaatttgtct

SEQ ID NO: 120619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atagacaggaaatttgtctt

SEQ ID NO: 120620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcttaggcatgtattatca

SEQ ID NO: 120621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttaggcatgtattatcac

SEQ ID NO: 120622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aggcatgtattatcaccaag

SEQ ID NO: 120623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggcatgtattatcaccaagg

SEQ ID NO: 120624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaccaaggtataacatgat

SEQ ID NO: 120625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcacatcatataaaattgtt

SEQ ID NO: 120626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaaatgcttgatgaatgaa

SEQ ID NO: 120627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgcttgatgaatgaagat

SEQ ID NO: 120628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatgaatgaagatggtgaaa

SEQ ID NO: 120629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgaatgaagatggtgaaat

SEQ ID NO: 120630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcctaacccaagcacttga

SEQ ID NO: 120631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctaacccaagcacttgaa

SEQ ID NO: 120632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctaacccaagcacttgaaga

SEQ ID NO: 120633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acccaagcacttgaagaagc

SEQ ID NO: 120634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaagaagcacgctatctaat

SEQ ID NO: 120635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagaagcacgctatctaatt

SEQ ID NO: 120636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctaattatattgcctttaa

SEQ ID NO: 120637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attatattgcctttaacata

SEQ ID NO: 120638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattgcctttaacatagatg

SEQ ID NO: 120639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctttaacatagatgtcaca

SEQ ID NO: 120640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taacatagatgtcacactaa

SEQ ID NO: 120641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacatagatgtcacactaat

SEQ ID NO: 120642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatagatgtcacactaatt

SEQ ID NO: 120643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttaagacaattttaatta

SEQ ID NO: 120644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagacaattttaattattat

SEQ ID NO: 120645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agacaattttaattattatt

SEQ ID NO: 120646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattattatttaacaaaat

SEQ ID NO: 120647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattattatttaacaaaatt

SEQ ID NO: 120648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attattatttaacaaaattt

SEQ ID NO: 120649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatttaacaaaattttcta

SEQ ID NO: 120650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaacaaaattttctaaga

SEQ ID NO: 120651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacaaaattttctaagattt

SEQ ID NO: 120652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaaaattttctaagatttt

SEQ ID NO: 120653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctaagatttttcagtgttc

SEQ ID NO: 120654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaagatttttcagtgttcc

SEQ ID NO: 120655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taagatttttcagtgttcca

SEQ ID NO: 120656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agatttttcagtgttccaag

SEQ ID NO: 120657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcagtgttccaagagcatc

SEQ ID NO: 120658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagtgttccaagagcatct

SEQ ID NO: 120659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagtgttccaagagcatctt

SEQ ID NO: 120660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtgttccaagagcatcttc

SEQ ID NO: 120661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caagagcatcttcaaacatt

SEQ ID NO: 120662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaacatttacaataatcca

SEQ ID NO: 120663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaacatttacaataatccat

SEQ ID NO: 120664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaataatccataactatca

SEQ ID NO: 120665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caataatccataactatcat

SEQ ID NO: 120666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcattgattttacatcagaa

SEQ ID NO: 120667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attttacatcagaaacgcta

SEQ ID NO: 120668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacatcagaaacgctatctt

SEQ ID NO: 120669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatcagaaacgctatcttt

SEQ ID NO: 120670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catcagaaacgctatcttta

SEQ ID NO: 120671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctttaatttatggcactct

SEQ ID NO: 120672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taatttatggcactctcaat

SEQ ID NO: 120673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttatggcactctcaatt

SEQ ID NO: 120674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttatggcactctcaattg

SEQ ID NO: 120675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atggcactctcaattgctct

SEQ ID NO: 120676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggcactctcaattgctctt

SEQ ID NO: 120677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaattgctctttttctcct

SEQ ID NO: 120678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aattgctctttttctcctca

SEQ ID NO: 120679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctctttttctcctcattaaa

SEQ ID NO: 120680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttttctcctcattaaaaaa

SEQ ID NO: 120681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttctcctcattaaaaaaat

SEQ ID NO: 120682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctcctcattaaaaaaatt

SEQ ID NO: 120683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctcctcattaaaaaaatta

SEQ ID NO: 120684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcctcattaaaaaaattaa

SEQ ID NO: 120685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctcattaaaaaaattaaa

SEQ ID NO: 120686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcattaaaaaaattaaaac

SEQ ID NO: 120687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attaaaaaaattaaaacatt

SEQ ID NO: 120688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaattaaaacattgaaa

SEQ ID NO: 120689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaacattgaaaaacaaagca

SEQ ID NO: 120690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaacaaagcaatttccat

SEQ ID NO: 120691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccatccttttatggaggctg

SEQ ID NO: 120692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catccttttatggaggctga

SEQ ID NO: 120693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatggaggctgatatgtgc

SEQ ID NO: 120694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatggaggctgatatgtgca

SEQ ID NO: 120695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atggaggctgatatgtgcaa

SEQ ID NO: 120696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggaggctgatatgtgcaaa

SEQ ID NO: 120697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atatgtgcaaaaaatataag

SEQ ID NO: 120698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgctattacaacctgtttcc

SEQ ID NO: 120699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctattacaacctgtttcccc

SEQ ID NO: 120700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttacaacctgtttccccatt

SEQ ID NO: 120701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caacctgtttccccatttta

SEQ ID NO: 120702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttccccattttagtgacat

SEQ ID NO: 120703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccccattttagtgacatcga

SEQ ID NO: 120704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccattttagtgacatcgaa

SEQ ID NO: 120705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagtgacatcgaaatacaat

SEQ ID NO: 120706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtgacatcgaaatacaatt

SEQ ID NO: 120707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgacatcgaaatacaattt

SEQ ID NO: 120708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaacaacactatctgctt

SEQ ID NO: 120709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaacaacactatctgctta

SEQ ID NO: 120710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctgcttaggtttaattaaa

SEQ ID NO: 120711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttaggtttaattaaagtag

SEQ ID NO: 120712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aggtttaattaaagtagctt

SEQ ID NO: 120713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtttaattaaagtagcttt

SEQ ID NO: 120714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattaaagtagctttttttt

SEQ ID NO: 120715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attaaagtagcttttttttt

SEQ ID NO: 120716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtagctttttttttcccc

SEQ ID NO: 120717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttttccccagccataaa

SEQ ID NO: 120718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttccccagccataaac

SEQ ID NO: 120719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttccccagccataaaca

SEQ ID NO: 120720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttccccagccataaacag

SEQ ID NO: 120721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttccccagccataaacagg

SEQ ID NO: 120722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccccagccataaacagga

SEQ ID NO: 120723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccccagccataaacaggaa

SEQ ID NO: 120724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccccagccataaacaggaag

SEQ ID NO: 120725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccagccataaacaggaagg

SEQ ID NO: 120726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagtttggtcagatggatg

SEQ ID NO: 120727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtcagatggatgaaaaggg

SEQ ID NO: 120728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtcagatggatgaaaagggg

SEQ ID NO: 120729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtttaaaattctctaatt

SEQ ID NO: 120730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaattctctaatttgggat

SEQ ID NO: 120731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattctctaatttgggatt

SEQ ID NO: 120732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctaatttgggattacacaa

SEQ ID NO: 120733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taatttgggattacacaaat

SEQ ID NO: 120734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttgggattacacaaatcc

SEQ ID NO: 120735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggattacacaaatcccaaa

SEQ ID NO: 120736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggattacacaaatcccaaag

SEQ ID NO: 120737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacaaatcccaaagttttta

SEQ ID NO: 120738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaagttcacagcagaactt

SEQ ID NO: 120739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagttcacagcagaactta

SEQ ID NO: 120740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagttcacagcagaacttaa

SEQ ID NO: 120741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agttcacagcagaacttaaa

SEQ ID NO: 120742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acagcagaacttaaaaatac

SEQ ID NO: 120743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaaatacattaggcacatt

SEQ ID NO: 120744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatacattaggcacattt

SEQ ID NO: 120745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggcacattttgacatgttca

SEQ ID NO: 120746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgacatgttcaccagtactt

SEQ ID NO: 120747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacatgttcaccagtactta

SEQ ID NO: 120748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acatgttcaccagtacttaa

SEQ ID NO: 120749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accagtacttaagcacctta

SEQ ID NO: 120750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagcaccttaaaattgtaga

SEQ ID NO: 120751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcaccttaaaattgtagat

SEQ ID NO: 120752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaattgtagatattttatt

SEQ ID NO: 120753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattgtagatattttattt

SEQ ID NO: 120754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagatattttatttgaaaca

SEQ ID NO: 120755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttgaaacatatatttaa

SEQ ID NO: 120756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttgaaacatatatttaag

SEQ ID NO: 120757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgaaacatatatttaagg

SEQ ID NO: 120758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaacatatatttaaggaca

SEQ ID NO: 120759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaacatatatttaaggacaa

SEQ ID NO: 120760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaggacaaattgccaaatct

SEQ ID NO: 120761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggacaaattgccaaatctt

SEQ ID NO: 120762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccaaatctttgaacatccaa

SEQ ID NO: 120763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaacatccaacaaagcgat

SEQ ID NO: 120764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaacatccaacaaagcgatc

SEQ ID NO: 120765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacatccaacaaagcgatca

SEQ ID NO: 120766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattgttttagaaacctagg

SEQ ID NO: 120767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attgttttagaaacctaggc

SEQ ID NO: 120768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttagaaacctaggcacag

SEQ ID NO: 120769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagaaacctaggcacagata

SEQ ID NO: 120770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaaacctaggcacagatac

SEQ ID NO: 120771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaacctaggcacagataca

SEQ ID NO: 120772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggcacagatacaatcctaga

SEQ ID NO: 120773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatggttgattaaccctaac

SEQ ID NO: 120774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attaaccctaacttaatttt

SEQ ID NO: 120775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
accctaacttaatttttgcc

SEQ ID NO: 120776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acttaatttttgccattaaa

SEQ ID NO: 120777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatttttgccattaaaatag

SEQ ID NO: 120778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttttgccattaaaatagt

SEQ ID NO: 120779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgccattaaaatagtttat

SEQ ID NO: 120780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgccattaaaatagtttatg

SEQ ID NO: 120781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccattaaaatagtttatgc

SEQ ID NO: 120782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccattaaaatagtttatgca

SEQ ID NO: 120783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatagtttatgcagtttga

SEQ ID NO: 120784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgcagtttgaagcttgtac

SEQ ID NO: 120785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcagtttgaagcttgtacg

SEQ ID NO: 120786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaagcttgtacgcaaataac

SEQ ID NO: 120787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagcttgtacgcaaataaca

SEQ ID NO: 120788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtacgcaaataacagggaga

SEQ ID NO: 120789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tacgcaaataacagggagaa

SEQ ID NO: 120790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tactgaaaagatttcatttc

SEQ ID NO: 120791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaagatttcatttccatta

SEQ ID NO: 120792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catttccattaaatccaaga

SEQ ID NO: 120793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttccattaaatccaagac

SEQ ID NO: 120794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccattaaatccaagacacat

SEQ ID NO: 120795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattaaatccaagacacatt

SEQ ID NO: 120796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatccaagacacatttattt

SEQ ID NO: 120797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttgcagaaagttgcacat

SEQ ID NO: 120798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgcagaaagttgcacatg

SEQ ID NO: 120799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcagaaagttgcacatgtga

SEQ ID NO: 120800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagaaagttgcacatgtgac

SEQ ID NO: 120801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cacatgtgactaatttgggg

SEQ ID NO: 120802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttggggttattaatatgg

SEQ ID NO: 120803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggggttattaatatggttga

SEQ ID NO: 120804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggttattaatatggttgaa

SEQ ID NO: 120805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaatatggttgaatataaa

SEQ ID NO: 120806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatggttgaatataaatat

SEQ ID NO: 120807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatataaatatagcaaattt

SEQ ID NO: 120808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattgggagaaaatttaga

SEQ ID NO: 120809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattgggagaaaatttagaa

SEQ ID NO: 120810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attgggagaaaatttagaaa

SEQ ID NO: 120811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggagaaaatttagaaaactg

SEQ ID NO: 120812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaaaactgaaaagcataga

SEQ ID NO: 120813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaaactgaaaagcatagaa

SEQ ID NO: 120814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaagcatagaaaaaaataa

SEQ ID NO: 120815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acctattccaagaaaattac

SEQ ID NO: 120816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttccaagaaaattactgatt

SEQ ID NO: 120817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caagaaaattactgattttt

SEQ ID NO: 120818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgatttttttttttaaaga

SEQ ID NO: 120819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atttttttttttaaagagac

SEQ ID NO: 120820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttaaagagacaatg

SEQ ID NO: 120821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttaaagagacaatgt

SEQ ID NO: 120822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttaaagagacaatgtc

SEQ ID NO: 120823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttaaagagacaatgtct

SEQ ID NO: 120824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaaagagacaatgtctc

SEQ ID NO: 120825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaagagacaatgtctcc

SEQ ID NO: 120826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaagagacaatgtctcct

SEQ ID NO: 120827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaagagacaatgtctccta

SEQ ID NO: 120828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagagacaatgtctcctac

SEQ ID NO: 120829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagagacaatgtctcctact

SEQ ID NO: 120830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctactgttacccaggctgtg

SEQ ID NO: 120831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgttacccaggctgtggtg

SEQ ID NO: 120832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttacccaggctgtggtgcaa

SEQ ID NO: 120833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccaggctgtggtgcaatca

SEQ ID NO: 120834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggtgcaatcatagctgact

SEQ ID NO: 120835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actgcaacctccaaacctca

SEQ ID NO: 120836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caacctccaaacctcatggg

SEQ ID NO: 120837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caaacctcatgggctcaagt

SEQ ID NO: 120838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgggctcaagtgttcttcc

SEQ ID NO: 120839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagtgttcttcccacctcag

SEQ ID NO: 120840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcccacctcagcctcccaa

SEQ ID NO: 120841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccacctcagcctcccaagt

SEQ ID NO: 120842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccacctcagcctcccaagta

SEQ ID NO: 120843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcctcccaagtagctagga

SEQ ID NO: 120844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaagtagctaggactacag

SEQ ID NO: 120845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggactacaggtgtgcaccac

SEQ ID NO: 120846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caggtgtgcaccactatgtc

SEQ ID NO: 120847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtctggctaattttttttt

SEQ ID NO: 120848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctaatttttttttttaatg

SEQ ID NO: 120849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttttttttttaatggagt

SEQ ID NO: 120850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttaatggagtctct

SEQ ID NO: 120851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttaatggagtctctc

SEQ ID NO: 120852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttaatggagtctctct

SEQ ID NO: 120853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttaatggagtctctctc

SEQ ID NO: 120854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaatggagtctctctct

SEQ ID NO: 120855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaatggagtctctctctg

SEQ ID NO: 120856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaatggagtctctctctgt

SEQ ID NO: 120857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatggagtctctctctgtc

SEQ ID NO: 120858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatggagtctctctctgtca

SEQ ID NO: 120859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atggagtctctctctgtcac

SEQ ID NO: 120860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctctgtcacccaggctgga

SEQ ID NO: 120861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctgtcacccaggctggagt

SEQ ID NO: 120862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtcacccaggctggagtgc

SEQ ID NO: 120863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcacccaggctggagtgcag

SEQ ID NO: 120864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagtgcagtgatatgatctc

SEQ ID NO: 120865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggctcactccatcactgcaa

SEQ ID NO: 120866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actccatcactgcaacctct

SEQ ID NO: 120867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catcactgcaacctctgcct

SEQ ID NO: 120868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caacctctgcctcttggcag

SEQ ID NO: 120869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcctcttggcagcactggg

SEQ ID NO: 120870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctcttggcagcactgggat

SEQ ID NO: 120871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttggcagcactgggataaca

SEQ ID NO: 120872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcagcactgggataacagg

SEQ ID NO: 120873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcagcactgggataacaggc

SEQ ID NO: 120874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggataacaggcatgagccac

SEQ ID NO: 120875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcttcttttatatatatata

SEQ ID NO: 120876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttttatatatatatacata

SEQ ID NO: 120877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttatatatatatacatac

SEQ ID NO: 120878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatatatatatacatactg

SEQ ID NO: 120879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatatatatatacatactga

SEQ ID NO: 120880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatatatatacatactgac

SEQ ID NO: 120881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatatatatacatactgaca

SEQ ID NO: 120882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acaaaatgtttccagaaagg

SEQ ID NO: 120883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccagaaaggctataaaaatg

SEQ ID NO: 120884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagaaaggctataaaaatgt

SEQ ID NO: 120885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaaaatgtatatcattttt

SEQ ID NO: 120886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagcaacatgtaagcatat

SEQ ID NO: 120887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagcaacatgtaagcatata

SEQ ID NO: 120888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcaacatgtaagcatatat

SEQ ID NO: 120889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaacatgtaagcatatatt

SEQ ID NO: 120890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcccacaatgttaagtatag

SEQ ID NO: 120891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccacaatgttaagtatagt

SEQ ID NO: 120892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccacaatgttaagtatagtc

SEQ ID NO: 120893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtatagtcatttaaaaaaa

SEQ ID NO: 120894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaaaaacttcataattt

SEQ ID NO: 120895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaaaacttcataatttg

SEQ ID NO: 120896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cataatttgatatttaaaac

SEQ ID NO: 120897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataatttgatatttaaaacg

SEQ ID NO: 120898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatatttaaaacgtttttat

SEQ ID NO: 120899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atatttaaaacgtttttatc

SEQ ID NO: 120900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaacgtttttatctaaaat

SEQ ID NO: 120901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaacgtttttatctaaaatg

SEQ ID NO: 120902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatctaaaatgtgaatttc

SEQ ID NO: 120903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatctaaaatgtgaatttcg

SEQ ID NO: 120904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctaaaatgtgaatttcgt

SEQ ID NO: 120905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctaaaatgtgaatttcgtg

SEQ ID NO: 120906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatgtgaatttcgtgaaac

SEQ ID NO: 120907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgtgaaacatttctagttct

SEQ ID NO: 120908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gtgaaacatttctagttctt

SEQ ID NO: 120909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctagttcttctttggtcagt

SEQ ID NO: 120910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagttcttctttggtcagtg

SEQ ID NO: 120911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gttcttctttggtcagtgtc

SEQ ID NO: 120912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctttggtcagtgtcttta

SEQ ID NO: 120913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttggtcagtgtctttagt

SEQ ID NO: 120914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttggtcagtgtctttagtc

SEQ ID NO: 120915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggtcagtgtctttagtctc

SEQ ID NO: 120916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtcagtgtctttagtctct

SEQ ID NO: 120917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtcagtgtctttagtctctt

SEQ ID NO: 120918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagtctcttgatcttttttc

SEQ ID NO: 120919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtctcttgatcttttttct

SEQ ID NO: 120920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtctcttgatcttttttcta

SEQ ID NO: 120921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgatcttttttctattgaa

SEQ ID NO: 120922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatcttttttctattgaaat

SEQ ID NO: 120923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcttttttctattgaaata

SEQ ID NO: 120924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttctattgaaatattcat

SEQ ID NO: 120925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctattgaaatattcatt

SEQ ID NO: 120926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctattgaaatattcatta

SEQ ID NO: 120927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctattgaaatattcattat

SEQ ID NO: 120928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctattgaaatattcattatt

SEQ ID NO: 120929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattgaaatattcattattt

SEQ ID NO: 120930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgaaatattcattattttc

SEQ ID NO: 120931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatattcattattttcttg

SEQ ID NO: 120932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attattttcttgtttgccaa

SEQ ID NO: 120933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcttgtttgccaaggga

SEQ ID NO: 120934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttgtttgccaagggattg

SEQ ID NO: 120935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgtttgccaagggattgt

SEQ ID NO: 120936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgtttgccaagggattgtg

SEQ ID NO: 120937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtttgccaagggattgtgtg

SEQ ID NO: 120938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgccaagggattgtgtgt

SEQ ID NO: 120939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccaagggattgtgtgtgtg

SEQ ID NO: 120940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccaagggattgtgtgtgtgt

SEQ ID NO: 120941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtgtgtgtgtgggtgtgtg

SEQ ID NO: 120942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aggatattgataccttttca

SEQ ID NO: 120943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataccttttcacaaaaattt

SEQ ID NO: 120944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcacaaaaatttctttttt

SEQ ID NO: 120945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcacaaaaatttcttttttt

SEQ ID NO: 120946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacaaaaatttctttttttt

SEQ ID NO: 120947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaaaaatttcttttttttt

SEQ ID NO: 120948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttttttttcttttgcca

SEQ ID NO: 120949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttttttttcttttgccag

SEQ ID NO: 120950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttttttcttttgccagtt

SEQ ID NO: 120951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttcttttgccagttt

SEQ ID NO: 120952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttcttttgccagtttg

SEQ ID NO: 120953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttcttttgccagtttgt

SEQ ID NO: 120954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttcttttgccagtttgtc

SEQ ID NO: 120955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcttttgccagtttgtca

SEQ ID NO: 120956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttttgccagtttgtcat

SEQ ID NO: 120957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttttgccagtttgtcatc

SEQ ID NO: 120958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttgccagtttgtcatct

SEQ ID NO: 120959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttgccagtttgtcatctt

SEQ ID NO: 120960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgccagtttgtcatctttt

SEQ ID NO: 120961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgccagtttgtcatctttta

SEQ ID NO: 120962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccagtttgtcatcttttaa

SEQ ID NO: 120963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccagtttgtcatcttttaac

SEQ ID NO: 120964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcatcttttaactttgtct

SEQ ID NO: 120965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcatcttttaactttgtctt

SEQ ID NO: 120966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaactttgtctttactaaa

SEQ ID NO: 120967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taactttgtctttactaaaa

SEQ ID NO: 120968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactttgtctttactaaaac

SEQ ID NO: 120969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actttgtctttactaaaact

SEQ ID NO: 120970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtctttactaaaactggtt

SEQ ID NO: 120971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtctttactaaaactggttt

SEQ ID NO: 120972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctttactaaaactggtttt

SEQ ID NO: 120973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tactaaaactggttttcaaa

SEQ ID NO: 120974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actaaaactggttttcaaaa

SEQ ID NO: 120975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaaaactggttttcaaaaa

SEQ ID NO: 120976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaactggttttcaaaaatga

SEQ ID NO: 120977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttttcaaaaatgaatagaa

SEQ ID NO: 120978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaaaatgaatagaaatat

SEQ ID NO: 120979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaaatgaatagaaatata

SEQ ID NO: 120980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaatgaatagaaatatat

SEQ ID NO: 120981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctctttaaaggaattatgca

SEQ ID NO: 120982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttaaaggaattatgcagta

SEQ ID NO: 120983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaaggaattatgcagtaac

SEQ ID NO: 120984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaggaattatgcagtaact

SEQ ID NO: 120985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaggaattatgcagtaactt

SEQ ID NO: 120986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcagtaactttaacattaa

SEQ ID NO: 120987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taacattaaaaatatttacc

SEQ ID NO: 120988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacattaaaaatatttacct

SEQ ID NO: 120989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acattaaaaatatttacctt

SEQ ID NO: 120990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatatttacctttttgtg

SEQ ID NO: 120991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acctttttgtgcatatatat

SEQ ID NO: 120992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctttttgtgcatatatatg

SEQ ID NO: 120993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttgtgcatatatatgtttt

SEQ ID NO: 120994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtgcatatatatgttttc

SEQ ID NO: 120995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgcatatatatgttttcc

SEQ ID NO: 120996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgcatatatatgttttccc

SEQ ID NO: 120997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgcatatatatgttttccca

SEQ ID NO: 120998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcccattgggagggcagttt

SEQ ID NO: 120999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccattgggagggcagtttt

SEQ ID NO: 121000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccattgggagggcagtttta

SEQ ID NO: 121001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggagggcagttttattttca

SEQ ID NO: 121002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttcatgacatatttct

SEQ ID NO: 121003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttcatgacatatttctg

SEQ ID NO: 121004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcatgacatatttctgg

SEQ ID NO: 121005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatgacatatttctgggaa

SEQ ID NO: 121006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgacatatttctgggaaa

SEQ ID NO: 121007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgacatatttctgggaaac

SEQ ID NO: 121008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgggaaacataggcctaga

SEQ ID NO: 121009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgggaaacataggcctagaa

SEQ ID NO: 121010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaaacataggcctagaaat

SEQ ID NO: 121011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaatgagattttttttttt

SEQ ID NO: 121012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttttttgacagatt

SEQ ID NO: 121013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttgacagattc

SEQ ID NO: 121014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttttgacagattct

SEQ ID NO: 121015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttgacagattctc

SEQ ID NO: 121016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttgacagattctca

SEQ ID NO: 121017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttgacagattctcag

SEQ ID NO: 121018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttgacagattctcagt

SEQ ID NO: 121019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttgacagattctcagtc

SEQ ID NO: 121020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttgacagattctcagtct

SEQ ID NO: 121021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgacagattctcagtctg

SEQ ID NO: 121022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgacagattctcagtctgg

SEQ ID NO: 121023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgacagattctcagtctgga

SEQ ID NO: 121024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacagattctcagtctggag

SEQ ID NO: 121025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acagattctcagtctggagt

SEQ ID NO: 121026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcagtctggagtgcagtggc

SEQ ID NO: 121027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agtctggagtgcagtggcat

SEQ ID NO: 121028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagtgcagtggcatgatctc

SEQ ID NO: 121029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agctcactataacctctgcc

SEQ ID NO: 121030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actataacctctgcctcctg

SEQ ID NO: 121031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taacctctgcctcctggatt

SEQ ID NO: 121032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcctcctggattcaagtga

SEQ ID NO: 121033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctcctggattcaagtgatt

SEQ ID NO: 121034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctggattcaagtgattctcc

SEQ ID NO: 121035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gattcaagtgattctcctgc

SEQ ID NO: 121036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagtgattctcctgcctcag

SEQ ID NO: 121037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctgcctcagcctcctgag

SEQ ID NO: 121038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgcctcagcctcctgagta

SEQ ID NO: 121039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctcagcctcctgagtagct

SEQ ID NO: 121040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcctcctgagtagctggga

SEQ ID NO: 121041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgagtagctgggactatag

SEQ ID NO: 121042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtagctgggactataggtg

SEQ ID NO: 121043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggactataggtgcctgccac

SEQ ID NO: 121044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taggtgcctgccaccacgcc

SEQ ID NO: 121045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccaccacgcccagctaattt

SEQ ID NO: 121046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttttgtatttttagtagc

SEQ ID NO: 121047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtatttttagtagcgaca

SEQ ID NO: 121048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtatttttagtagcgacag

SEQ ID NO: 121049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatttttagtagcgacagg

SEQ ID NO: 121050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatttttagtagcgacaggg

SEQ ID NO: 121051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagtagcgacagggtttca

SEQ ID NO: 121052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagtagcgacagggtttcac

SEQ ID NO: 121053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtagcgacagggtttcacc

SEQ ID NO: 121054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtagcgacagggtttcacca

SEQ ID NO: 121055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caccatgttggccaggatgg

SEQ ID NO: 121056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accatgttggccaggatggt

SEQ ID NO: 121057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gccaggatggtcttgatctc

SEQ ID NO: 121058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatctcttgaccttgtgatc

SEQ ID NO: 121059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atctcttgaccttgtgatct

SEQ ID NO: 121060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgaccttgtgatctgcccg

SEQ ID NO: 121061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaccttgtgatctgcccgcc

SEQ ID NO: 121062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
accttgtgatctgcccgcct

SEQ ID NO: 121063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgatctgcccgccttggcc

SEQ ID NO: 121064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgatctgcccgccttggcct

SEQ ID NO: 121065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cccgccttggcctcccaaaa

SEQ ID NO: 121066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcctcccaaaatgctggga

SEQ ID NO: 121067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcctcccaaaatgctgggat

SEQ ID NO: 121068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaaaatgctgggattacag

SEQ ID NO: 121069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggattacaggcgtgagccac

SEQ ID NO: 121070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caggcgtgagccactgcgcc

SEQ ID NO: 121071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cgcctggccaaaatgaggtt

SEQ ID NO: 121072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gccaaaatgaggtttttcac

SEQ ID NO: 121073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcacacagtccctggagtc

SEQ ID NO: 121074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcacacagtccctggagtct

SEQ ID NO: 121075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacacagtccctggagtctt

SEQ ID NO: 121076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acacagtccctggagtcttg

SEQ ID NO: 121077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagtcttgtctgaggctggg

SEQ ID NO: 121078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtctgaggctgggtgaggct

SEQ ID NO: 121079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctgaggctgggtgaggctg

SEQ ID NO: 121080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggctgggtgaggctgcttc

SEQ ID NO: 121081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtgaggctgcttctttacc

SEQ ID NO: 121082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttctttacctcaaactgaa

SEQ ID NO: 121083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttacctcaaactgaacta

SEQ ID NO: 121084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttacctcaaactgaactat

SEQ ID NO: 121085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacctcaaactgaactatcc

SEQ ID NO: 121086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acctcaaactgaactatcct

SEQ ID NO: 121087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctcaaactgaactatcctg

SEQ ID NO: 121088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaactgaactatcctgctca

SEQ ID NO: 121089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aactatcctgctcagcctct

SEQ ID NO: 121090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcctgctcagcctctgcctc

SEQ ID NO: 121091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctcagcctctgcctcttttc

SEQ ID NO: 121092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcctctgcctcttttcttt

SEQ ID NO: 121093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcctcttttcttttctcag

SEQ ID NO: 121094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctcttttcttttctcagtg

SEQ ID NO: 121095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttcttttctcagtgtttg

SEQ ID NO: 121096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcttttctcagtgtttggg

SEQ ID NO: 121097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttttctcagtgtttgggt

SEQ ID NO: 121098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttctcagtgtttgggtc

SEQ ID NO: 121099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttctcagtgtttgggtca

SEQ ID NO: 121100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctcagtgtttgggtcatc

SEQ ID NO: 121101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctcagtgtttgggtcatcc

SEQ ID NO: 121102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcagtgtttgggtcatcca

SEQ ID NO: 121103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcagtgtttgggtcatccac

SEQ ID NO: 121104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agtgtttgggtcatccacct

SEQ ID NO: 121105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggtcatccacctcctcaga

SEQ ID NO: 121106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggtcatccacctcctcagag

SEQ ID NO: 121107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcagagctactgtacaaca

SEQ ID NO: 121108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agagctactgtacaacattt

SEQ ID NO: 121109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgtacaacatttttttatt

SEQ ID NO: 121110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tacaacatttttttatttag

SEQ ID NO: 121111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttatttagatttttgtat

SEQ ID NO: 121112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttatttagatttttgtata

SEQ ID NO: 121113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatttagatttttgtataa

SEQ ID NO: 121114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttagatttttgtataac

SEQ ID NO: 121115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttagatttttgtataacg

SEQ ID NO: 121116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttagatttttgtataacga

SEQ ID NO: 121117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agatttttgtataacgaagt

SEQ ID NO: 121118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatttttgtataacgaagtt

SEQ ID NO: 121119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtataacgaagtttcttt

SEQ ID NO: 121120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtataacgaagtttcttta

SEQ ID NO: 121121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtataacgaagtttctttaa

SEQ ID NO: 121122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tataacgaagtttctttaat

SEQ ID NO: 121123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttaatgcagatgactcta

SEQ ID NO: 121124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttaatgcagatgactctat

SEQ ID NO: 121125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taatgcagatgactctattc

SEQ ID NO: 121126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatgcagatgactctattct

SEQ ID NO: 121127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgcagatgactctattcta

SEQ ID NO: 121128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tattctaaataaaccttata

SEQ ID NO: 121129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttctaaataaaccttatatt

SEQ ID NO: 121130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaataaaccttatattaat

SEQ ID NO: 121131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aataaaccttatattaatac

SEQ ID NO: 121132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atattaatactctacatttt

SEQ ID NO: 121133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattaatactctacattttt

SEQ ID NO: 121134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atactctacatttttacaca

SEQ ID NO: 121135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tacatttttacacacataat

SEQ ID NO: 121136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catttttacacacataatgg

SEQ ID NO: 121137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttacacacataatggtttgc

SEQ ID NO: 121138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacacacataatggtttgca

SEQ ID NO: 121139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acacacataatggtttgcaa

SEQ ID NO: 121140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacacataatggtttgcaaa

SEQ ID NO: 121141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaaaaaacattcattcatt

SEQ ID NO: 121142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaaaaacattcattcattc

SEQ ID NO: 121143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attcattcattcattcaagt

SEQ ID NO: 121144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attcattcattcaagttcat

SEQ ID NO: 121145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attcattcaagttcattcca

SEQ ID NO: 121146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attcaagttcattccagaca

SEQ ID NO: 121147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagttcattccagacatatt

SEQ ID NO: 121148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attccagacatattttagag

SEQ ID NO: 121149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagacatattttagaggaac

SEQ ID NO: 121150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagaggaactattatttgat

SEQ ID NO: 121151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaggaactattatttgatt

SEQ ID NO: 121152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaggaactattatttgatta

SEQ ID NO: 121153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttatttgattatcatcctaa

SEQ ID NO: 121154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgattatcatcctaagca

SEQ ID NO: 121155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gattatcatcctaagcatca

SEQ ID NO: 121156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attatcatcctaagcatcag

SEQ ID NO: 121157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcatcctaagcatcagagca

SEQ ID NO: 121158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agcatcagagcagttagtaa

SEQ ID NO: 121159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtaactccaagaacagaaca

SEQ ID NO: 121160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caagaacagaacatttttaa

SEQ ID NO: 121161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaagttgaaaagttaggtc

SEQ ID NO: 121162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagttgaaaagttaggtcc

SEQ ID NO: 121163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagttgaaaagttaggtcca

SEQ ID NO: 121164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agttgaaaagttaggtccaa

SEQ ID NO: 121165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaagttaggtccaaattgc

SEQ ID NO: 121166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtccaaattgcaggtttat

SEQ ID NO: 121167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caggtttatgactcccattt

SEQ ID NO: 121168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgactcccattttttcccc

SEQ ID NO: 121169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgactcccattttttcccca

SEQ ID NO: 121170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccattttttccccataaata

SEQ ID NO: 121171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttccccataaatagcattc

SEQ ID NO: 121172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccccataaatagcattct

SEQ ID NO: 121173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccccataaatagcattctt

SEQ ID NO: 121174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccccataaatagcattctta

SEQ ID NO: 121175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccataaatagcattcttat

SEQ ID NO: 121176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatatttatttttgaagaa

SEQ ID NO: 121177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atatttatttttgaagaata

SEQ ID NO: 121178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatttatttttgaagaataa

SEQ ID NO: 121179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttttgaagaataaattta

SEQ ID NO: 121180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttgaagaataaatttag

SEQ ID NO: 121181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgaagaataaatttagcca

SEQ ID NO: 121182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaagaataaatttagccac

SEQ ID NO: 121183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaagaataaatttagccaca

SEQ ID NO: 121184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagaataaatttagccacaa

SEQ ID NO: 121185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agccacaaaactcaaaagta

SEQ ID NO: 121186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccacaaaactcaaaagtat

SEQ ID NO: 121187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaagtatgtataacgaaaa

SEQ ID NO: 121188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctcactcttcaatgtttcc

SEQ ID NO: 121189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcactcttcaatgtttccca

SEQ ID NO: 121190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actcttcaatgtttcccagc

SEQ ID NO: 121191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcaatgtttcccagccatc

SEQ ID NO: 121192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caatgtttcccagccatcca

SEQ ID NO: 121193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgtttcccagccatccaa

SEQ ID NO: 121194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccagccatccaaattcctc

SEQ ID NO: 121195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccagccatccaaattcctcc

SEQ ID NO: 121196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcccctgtggacaaccaca

SEQ ID NO: 121197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccctgtggacaaccacagta

SEQ ID NO: 121198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggacaaccacagtaccaac

SEQ ID NO: 121199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgtatccatccatgtggtt

SEQ ID NO: 121200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtatccatccatgtggttt

SEQ ID NO: 121201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcagcatgtatacatcta

SEQ ID NO: 121202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcagcatgtatacatctat

SEQ ID NO: 121203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcagcatgtatacatctatt

SEQ ID NO: 121204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttcatttttcttttcatgca

SEQ ID NO: 121205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttttcttttcatgcaaat

SEQ ID NO: 121206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttttcatgcaaataata

SEQ ID NO: 121207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttttcatgcaaataatac

SEQ ID NO: 121208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttcatgcaaataatacc

SEQ ID NO: 121209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttcatgcaaataataccc

SEQ ID NO: 121210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcatgcaaataatacccta

SEQ ID NO: 121211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatgcaaataataccctat

SEQ ID NO: 121212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgcaaataataccctata

SEQ ID NO: 121213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgcaaataataccctatat

SEQ ID NO: 121214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tataaacattgtttcatacc

SEQ ID NO: 121215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttcataccttccttcgtca

SEQ ID NO: 121216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cataccttccttcgtcactt

SEQ ID NO: 121217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataccttccttcgtcactta

SEQ ID NO: 121218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttcgtcacttaaaaatca

SEQ ID NO: 121219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttcgtcacttaaaaatcag

SEQ ID NO: 121220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cgtcacttaaaaatcagact

SEQ ID NO: 121221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gtcacttaaaaatcagactt

SEQ ID NO: 121222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaaatcagacttggaaatc

SEQ ID NO: 121223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatcagacttggaaatct

SEQ ID NO: 121224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaaatctttctgtatcagc

SEQ ID NO: 121225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaatctttctgtatcagca

SEQ ID NO: 121226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctgtatcagcatgtataaa

SEQ ID NO: 121227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtatcagcatgtataaag

SEQ ID NO: 121228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtatcagcatgtataaagc

SEQ ID NO: 121229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatcagcatgtataaagcta

SEQ ID NO: 121230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttctttttatagcagcttc

SEQ ID NO: 121231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttttatagcagcttcata

SEQ ID NO: 121232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttatagcagcttcataa

SEQ ID NO: 121233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttatagcagcttcataaag

SEQ ID NO: 121234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatagcagcttcataaagt

SEQ ID NO: 121235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatagcagcttcataaagtc

SEQ ID NO: 121236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagcagcttcataaagtcc

SEQ ID NO: 121237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagcagcttcataaagtcct

SEQ ID NO: 121238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cataaagtcctattgtacag

SEQ ID NO: 121239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataaagtcctattgtacagc

SEQ ID NO: 121240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgtacagctgtacccaaat

SEQ ID NO: 121241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tacagctgtacccaaattat

SEQ ID NO: 121242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tacccaaattatttagtcat

SEQ ID NO: 121243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttagtcattcccacactgt

SEQ ID NO: 121244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtcattcccacactgtaga

SEQ ID NO: 121245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtcattcccacactgtagaa

SEQ ID NO: 121246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccacactgtagaacatttag

SEQ ID NO: 121247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagaacatttaggttgtttc

SEQ ID NO: 121248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggttgtttcccaaagctac

SEQ ID NO: 121249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggttgtttcccaaagctaca

SEQ ID NO: 121250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttcccaaagctacaataat

SEQ ID NO: 121251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccaaagctacaataattat

SEQ ID NO: 121252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaaagctacaataattatc

SEQ ID NO: 121253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caataattatcttctcatta

SEQ ID NO: 121254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttctcattagtttttttc

SEQ ID NO: 121255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcattagtttttttctttt

SEQ ID NO: 121256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcattagtttttttcttttt

SEQ ID NO: 121257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attagtttttttcttttttt

SEQ ID NO: 121258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtttttttctttttttaacc

SEQ ID NO: 121259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttctttttttaacctact

SEQ ID NO: 121260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctttttttaacctactc

SEQ ID NO: 121261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctttttttaacctactct

SEQ ID NO: 121262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttttttaacctactctt

SEQ ID NO: 121263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttttttaacctactcttt

SEQ ID NO: 121264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttttaacctactctttt

SEQ ID NO: 121265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttaacctactcttttgt

SEQ ID NO: 121266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaacctactcttttgtg

SEQ ID NO: 121267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaacctactcttttgtgg

SEQ ID NO: 121268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaacctactcttttgtggg

SEQ ID NO: 121269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacctactcttttgtgggc

SEQ ID NO: 121270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacctactcttttgtgggct

SEQ ID NO: 121271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acctactcttttgtgggctc

SEQ ID NO: 121272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcttttgtgggctcttttt

SEQ ID NO: 121273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttgtgggctctttttgta

SEQ ID NO: 121274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgtgggctctttttgtaac

SEQ ID NO: 121275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgggctctttttgtaact

SEQ ID NO: 121276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgggctctttttgtaactt

SEQ ID NO: 121277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgggctctttttgtaacttt

SEQ ID NO: 121278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttttgtaacttttatttta

SEQ ID NO: 121279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttgtaacttttattttaag

SEQ ID NO: 121280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtaacttttattttaagt

SEQ ID NO: 121281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaacttttattttaagtt

SEQ ID NO: 121282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaacttttattttaagttc

SEQ ID NO: 121283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taacttttattttaagttca

SEQ ID NO: 121284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttattttaagttcaggggta

SEQ ID NO: 121285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttaagttcaggggtac

SEQ ID NO: 121286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttaagttcaggggtaca

SEQ ID NO: 121287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaagttcaggggtacat

SEQ ID NO: 121288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagttcaggggtacatgca

SEQ ID NO: 121289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagttcaggggtacatgcac

SEQ ID NO: 121290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agttcaggggtacatgcaca

SEQ ID NO: 121291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggggtacatgcacaggttt

SEQ ID NO: 121292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttacacagggaaacttgtg

SEQ ID NO: 121293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttacacagggaaacttgtgt

SEQ ID NO: 121294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacagggaaacttgtgttac

SEQ ID NO: 121295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgttacagggttttgttct

SEQ ID NO: 121296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgttacagggttttgttcta

SEQ ID NO: 121297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagggttttgttctacatct

SEQ ID NO: 121298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttctacatcttatttcat

SEQ ID NO: 121299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttctacatcttatttcatc

SEQ ID NO: 121300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttctacatcttatttcatca

SEQ ID NO: 121301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacatcttatttcatcacca

SEQ ID NO: 121302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catcttatttcatcaccaag

SEQ ID NO: 121303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttcatcaccaaggtctta

SEQ ID NO: 121304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcatcaccaaggtcttaa

SEQ ID NO: 121305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catcaccaaggtcttaagcc

SEQ ID NO: 121306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcaccaaggtcttaagcca

SEQ ID NO: 121307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagccaagtacttattagtt

SEQ ID NO: 121308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agccaagtacttattagtta

SEQ ID NO: 121309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attagttatttttcctgatc

SEQ ID NO: 121310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttagttatttttcctgatcc

SEQ ID NO: 121311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttatttttcctgatcccct

SEQ ID NO: 121312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttcctgatcccctccct

SEQ ID NO: 121313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcctgatcccctccctcct

SEQ ID NO: 121314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctgatcccctccctcctg

SEQ ID NO: 121315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgatcccctccctcctgc

SEQ ID NO: 121316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgatcccctccctcctgcc

SEQ ID NO: 121317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atcccctccctcctgccacc

SEQ ID NO: 121318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctcctgccaccctccaccc

SEQ ID NO: 121319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgccaccctccaccctcca

SEQ ID NO: 121320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccaccctccaccctccaatg

SEQ ID NO: 121321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caccctccaatgggccccag

SEQ ID NO: 121322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caatgggccccagtgtgtgt

SEQ ID NO: 121323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttcccacctatgtgtccatg

SEQ ID NO: 121324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccacctatgtgtccatgtgt

SEQ ID NO: 121325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtgtccatgtgttctcatc

SEQ ID NO: 121326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcatcatttagctctcactt

SEQ ID NO: 121327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atcatttagctctcacttat

SEQ ID NO: 121328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agctctcacttataagtgag

SEQ ID NO: 121329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctctcacttataagtgagg

SEQ ID NO: 121330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcacttataagtgaggacat

SEQ ID NO: 121331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acttataagtgaggacattc

SEQ ID NO: 121332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataagtgaggacattctctt

SEQ ID NO: 121333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taagtgaggacattctcttg

SEQ ID NO: 121334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttgaatagtttcacagta

SEQ ID NO: 121335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgaatagtttcacagtacg

SEQ ID NO: 121336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaatagtttcacagtacggt

SEQ ID NO: 121337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatagtttcacagtacggta

SEQ ID NO: 121338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacagtacggtattttattt

SEQ ID NO: 121339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acagtacggtattttatttg

SEQ ID NO: 121340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttgtaagacaaatgctt

SEQ ID NO: 121341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttgtaagacaaatgcttc

SEQ ID NO: 121342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgtaagacaaatgcttca

SEQ ID NO: 121343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaagacaaatgcttcagag

SEQ ID NO: 121344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagacaaatgcttcagagt

SEQ ID NO: 121345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagagtgaaattgctgagtc

SEQ ID NO: 121346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agagtgaaattgctgagtca

SEQ ID NO: 121347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgagtcataattgtatgtg

SEQ ID NO: 121348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtcataattgtatgtgcgt

SEQ ID NO: 121349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatgtgcgtttttaatttgc

SEQ ID NO: 121350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaatttgccataataaaat

SEQ ID NO: 121351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatttgccataataaaata

SEQ ID NO: 121352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttgccataataaaatat

SEQ ID NO: 121353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttgccataataaaatatt

SEQ ID NO: 121354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccataataaaatattgccg

SEQ ID NO: 121355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccataataaaatattgccga

SEQ ID NO: 121356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccgaattctcttttgttacc

SEQ ID NO: 121357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttttgttacctagtgtaa

SEQ ID NO: 121358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttgttacctagtgtaacg

SEQ ID NO: 121359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgttacctagtgtaacgcc

SEQ ID NO: 121360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttacctagtgtaacgcct

SEQ ID NO: 121361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttacctagtgtaacgccta

SEQ ID NO: 121362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttacctagtgtaacgcctac

SEQ ID NO: 121363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctagtgtaacgcctacagg

SEQ ID NO: 121364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtgtaacgcctacagggcca

SEQ ID NO: 121365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagggccatagctgaatttc

SEQ ID NO: 121366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatttctatcctaccctaac

SEQ ID NO: 121367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatcctaccctaactctgc

SEQ ID NO: 121368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatcctaccctaactctgct

SEQ ID NO: 121369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcctaccctaactctgctga

SEQ ID NO: 121370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccctaactctgctgatcttt

SEQ ID NO: 121371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actctgctgatctttaagaa

SEQ ID NO: 121372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgctgatctttaagaaacag

SEQ ID NO: 121373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctgatctttaagaaacaggt

SEQ ID NO: 121374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atctttaagaaacaggtaaa

SEQ ID NO: 121375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taagaaacaggtaaaatgtt

SEQ ID NO: 121376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagaaacaggtaaaatgttc

SEQ ID NO: 121377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaaacaggtaaaatgttcc

SEQ ID NO: 121378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catttgtaaccagagcagct

SEQ ID NO: 121379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaaccagagcagctgagat

SEQ ID NO: 121380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaccagagcagctgagatt

SEQ ID NO: 121381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agattgcttagaaccaagat

SEQ ID NO: 121382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttagaaccaagatagttga

SEQ ID NO: 121383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaaccaagatagttgacta

SEQ ID NO: 121384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaccaagatagttgactaa

SEQ ID NO: 121385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actaaaggacttcaagaaga

SEQ ID NO: 121386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaggacttcaagaagacctc

SEQ ID NO: 121387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caagaagacctcaggcatca

SEQ ID NO: 121388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagaagacctcaggcatcat

SEQ ID NO: 121389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggcatcattataatctcat

SEQ ID NO: 121390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatctcattttcatgctaa

SEQ ID NO: 121391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attttcatgctaaatgacac

SEQ ID NO: 121392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatgctaaatgacaccccc

SEQ ID NO: 121393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgctaaatgacaccccca

SEQ ID NO: 121394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgctaaatgacacccccac

SEQ ID NO: 121395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatgacacccccaccagtgc

SEQ ID NO: 121396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataatccccatgacaatgac

SEQ ID NO: 121397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tggttccaagaagttcacca

SEQ ID NO: 121398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttccaagaagttcaccacc

SEQ ID NO: 121399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caagaagttcaccacctatt

SEQ ID NO: 121400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accacctatttctggaaaag

SEQ ID NO: 121401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttctggaaaagacatgaac

SEQ ID NO: 121402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctggaaaagacatgaacatt

SEQ ID NO: 121403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggaaaagacatgaacattc

SEQ ID NO: 121404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaaagacatgaacattcct

SEQ ID NO: 121405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcccctcactcttaatgac

SEQ ID NO: 121406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccctcactcttaatgaccaa

SEQ ID NO: 121407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actcttaatgaccaacttct

SEQ ID NO: 121408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaatgaccaacttcttcat

SEQ ID NO: 121409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatgaccaacttcttcatta

SEQ ID NO: 121410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgaccaacttcttcattag

SEQ ID NO: 121411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttcattagatatactttct

SEQ ID NO: 121412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcattagatatactttcta

SEQ ID NO: 121413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattagatatactttctatt

SEQ ID NO: 121414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attagatatactttctattt

SEQ ID NO: 121415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatatactttctatttcaat

SEQ ID NO: 121416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctatttcaatttcctcact

SEQ ID NO: 121417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatttcaatttcctcactc

SEQ ID NO: 121418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatttcaatttcctcactcc

SEQ ID NO: 121419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttcaatttcctcactcctc

SEQ ID NO: 121420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatttcctcactcctcact

SEQ ID NO: 121421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatttcctcactcctcacta

SEQ ID NO: 121422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctcactcctcactagtcaa

SEQ ID NO: 121423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcactcctcactagtcaag

SEQ ID NO: 121424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actcctcactagtcaagaag

SEQ ID NO: 121425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcactagtcaagaagttag

SEQ ID NO: 121426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actagtcaagaagttagctt

SEQ ID NO: 121427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtcaagaagttagcttgtgc

SEQ ID NO: 121428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcttgtgcgccatacttgca

SEQ ID NO: 121429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgcgccatacttgcacttc

SEQ ID NO: 121430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgcgccatacttgcacttct

SEQ ID NO: 121431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcacttctccattctttggc

SEQ ID NO: 121432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cacttctccattctttggcc

SEQ ID NO: 121433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctccattctttggccatcga

SEQ ID NO: 121434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccattctttggccatcgaa

SEQ ID NO: 121435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cattctttggccatcgaata

SEQ ID NO: 121436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttggccatcgaataaagct

SEQ ID NO: 121437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggccatcgaataaagcttg

SEQ ID NO: 121438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggccatcgaataaagcttgc

SEQ ID NO: 121439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gccatcgaataaagcttgca

SEQ ID NO: 121440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcattgcttgatgctcactt

SEQ ID NO: 121441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattgcttgatgctcacttt

SEQ ID NO: 121442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttgatgctcactttcccat

SEQ ID NO: 121443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatgctcactttcccatttc

SEQ ID NO: 121444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgctcactttcccatttct

SEQ ID NO: 121445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actttcccatttcttgtatt

SEQ ID NO: 121446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcccatttcttgtattgggt

SEQ ID NO: 121447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccatttcttgtattgggtc

SEQ ID NO: 121448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccatttcttgtattgggtct

SEQ ID NO: 121449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgtattgggtctccaata

SEQ ID NO: 121450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgtattgggtctccaatac

SEQ ID NO: 121451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtattgggtctccaatacca

SEQ ID NO: 121452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattgggtctccaataccaa

SEQ ID NO: 121453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggtctccaataccaaacagg

SEQ ID NO: 121454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caataccaaacagggaaaga

SEQ ID NO: 121455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgaaactaccaaggaggtt

SEQ ID NO: 121456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaaactaccaaggaggtta

SEQ ID NO: 121457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaactaccaaggaggttat

SEQ ID NO: 121458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaactaccaaggaggttatt

SEQ ID NO: 121459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccaaggaggttattggtata

SEQ ID NO: 121460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttggtatattggtaactcct

SEQ ID NO: 121461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtatattggtaactccttca

SEQ ID NO: 121462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtaactccttcataaaggcc

SEQ ID NO: 121463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttcataaaggcctatcaat

SEQ ID NO: 121464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cataaaggcctatcaatcca

SEQ ID NO: 121465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataaaggcctatcaatccat

SEQ ID NO: 121466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaatccatgctctccccaa

SEQ ID NO: 121467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tccccaaacaatgtgtcagg

SEQ ID NO: 121468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cccaaacaatgtgtcaggga

SEQ ID NO: 121469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgcacataccttcaataa

SEQ ID NO: 121470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcacataccttcaataaagt

SEQ ID NO: 121471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cacataccttcaataaagta

SEQ ID NO: 121472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caataaagtatttcataaat

SEQ ID NO: 121473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aataaagtatttcataaatt

SEQ ID NO: 121474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cataaattttttttcatctt

SEQ ID NO: 121475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataaattttttttcatcttt

SEQ ID NO: 121476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttcatctttgtgagcct

SEQ ID NO: 121477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttcatctttgtgagccta

SEQ ID NO: 121478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcatctttgtgagcctaa

SEQ ID NO: 121479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcatctttgtgagcctaat

SEQ ID NO: 121480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatctttgtgagcctaata

SEQ ID NO: 121481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catctttgtgagcctaataa

SEQ ID NO: 121482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atctttgtgagcctaataag

SEQ ID NO: 121483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtgagcctaataagtgggg

SEQ ID NO: 121484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgagcctaataagtgggga

SEQ ID NO: 121485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgagcctaataagtggggaa

SEQ ID NO: 121486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ataagtggggaataaaactt

SEQ ID NO: 121487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatttatttatttatttat

SEQ ID NO: 121488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttatttatttatttatt

SEQ ID NO: 121489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttatttatttattt

SEQ ID NO: 121490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttatttatttattta

SEQ ID NO: 121491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttatttatttattt

SEQ ID NO: 121492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttatttatttattta

SEQ ID NO: 121493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttatttatttattt

SEQ ID NO: 121494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttatttatttattta

SEQ ID NO: 121495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttatttatttattt

SEQ ID NO: 121496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttatttatttattta

SEQ ID NO: 121497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttatttatttattt

SEQ ID NO: 121498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttatttatttattta

SEQ ID NO: 121499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttatttatttattt

SEQ ID NO: 121500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttatttatttattta

SEQ ID NO: 121501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttatttatttattt

SEQ ID NO: 121502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttatttatttattta

SEQ ID NO: 121503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttatttatttattt

SEQ ID NO: 121504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttatttatttatttt

SEQ ID NO: 121505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttatttattttgag

SEQ ID NO: 121506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttatttattttgaga

SEQ ID NO: 121507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttattttgagatgg

SEQ ID NO: 121508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttattttgagatgga

SEQ ID NO: 121509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttattttgagatggagtc

SEQ ID NO: 121510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttattttgagatggagtcg

SEQ ID NO: 121511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttgagatggagtcgctc

SEQ ID NO: 121512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttgagatggagtcgctct

SEQ ID NO: 121513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgagatggagtcgctctctc

SEQ ID NO: 121514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagatggagtcgctctctca

SEQ ID NO: 121515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agatggagtcgctctctcat

SEQ ID NO: 121516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctcattgcccaggctggag

SEQ ID NO: 121517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcattgcccaggctggagtg

SEQ ID NO: 121518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attgcccaggctggagtgcc

SEQ ID NO: 121519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccaggctggagtgccttgg

SEQ ID NO: 121520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagtgccttggtgcgatctc

SEQ ID NO: 121521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtgcgatctcagctcactg

SEQ ID NO: 121522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgcgatctcagctcactgc

SEQ ID NO: 121523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agctcactgcaacatctgcc

SEQ ID NO: 121524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actgcaacatctgcctcctg

SEQ ID NO: 121525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caacatctgcctcctgggtt

SEQ ID NO: 121526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctcctgggttcaagcagtt

SEQ ID NO: 121527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgggttcaagcagttctcc

SEQ ID NO: 121528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggttcaagcagttctcctgc

SEQ ID NO: 121529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagcagttctcctgcctcag

SEQ ID NO: 121530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctgcctcagcctcctgag

SEQ ID NO: 121531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgcctcagcctcctgagta

SEQ ID NO: 121532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctcagcctcctgagtagct

SEQ ID NO: 121533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcctcctgagtagctcgga

SEQ ID NO: 121534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgagtagctcggattagag

SEQ ID NO: 121535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtagctcggattagaggta

SEQ ID NO: 121536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggattagaggtacccaccac

SEQ ID NO: 121537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaggtacccaccaccacacc

SEQ ID NO: 121538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttttgtacctttagtaga

SEQ ID NO: 121539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtacctttagtagagaca

SEQ ID NO: 121540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtacctttagtagagacag

SEQ ID NO: 121541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtacctttagtagagacagg

SEQ ID NO: 121542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tacctttagtagagacaggt

SEQ ID NO: 121543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagtagagacaggttttcac

SEQ ID NO: 121544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtagagacaggttttcacc

SEQ ID NO: 121545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtagagacaggttttcacca

SEQ ID NO: 121546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaccatgttggccaggctg

SEQ ID NO: 121547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caccatgttggccaggctgg

SEQ ID NO: 121548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accatgttggccaggctggt

SEQ ID NO: 121549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gccaggctggtctccaactc

SEQ ID NO: 121550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtctccaactcctgacctca

SEQ ID NO: 121551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caactcctgacctcatgtga

SEQ ID NO: 121552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgacctcatgtgatccacc

SEQ ID NO: 121553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acctcatgtgatccacccat

SEQ ID NO: 121554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgtgatccacccatctcag

SEQ ID NO: 121555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcttcccaaagtgctggga

SEQ ID NO: 121556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccaaagtgctgggatcaca

SEQ ID NO: 121557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaaagtgctgggatcacaa

SEQ ID NO: 121558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggatcacaaacatgagccac

SEQ ID NO: 121559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttaattcttatcattttag

SEQ ID NO: 121560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaattcttatcattttagt

SEQ ID NO: 121561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aattcttatcattttagttt

SEQ ID NO: 121562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attcttatcattttagtttg

SEQ ID NO: 121563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatcattttagtttgcatt

SEQ ID NO: 121564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atcattttagtttgcatttt

SEQ ID NO: 121565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcattttagtttgcattttc

SEQ ID NO: 121566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagtttgcattttcttttgt

SEQ ID NO: 121567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtttgcattttcttttgtg

SEQ ID NO: 121568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtttgcattttcttttgtga

SEQ ID NO: 121569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcattttcttttgtgagtga

SEQ ID NO: 121570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattttcttttgtgagtgag

SEQ ID NO: 121571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttttgtgagtgaggtcag

SEQ ID NO: 121572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttgtgagtgaggtcagg

SEQ ID NO: 121573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttgtgagtgaggtcaggg

SEQ ID NO: 121574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgtgagtgaggtcagggat

SEQ ID NO: 121575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgagtgaggtcagggatc

SEQ ID NO: 121576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgagtgaggtcagggatct

SEQ ID NO: 121577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgagtgaggtcagggatctt

SEQ ID NO: 121578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcatatcctcagatgccat

SEQ ID NO: 121579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatatcctcagatgccatt

SEQ ID NO: 121580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catatcctcagatgccattt

SEQ ID NO: 121581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatcctcagatgccatttg

SEQ ID NO: 121582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agatgccatttgtgcttttt

SEQ ID NO: 121583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgcttttttttctgtgctc

SEQ ID NO: 121584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgcttttttttctgtgctct

SEQ ID NO: 121585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttttctgtgctctgtctg

SEQ ID NO: 121586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttctgtgctctgtctgt

SEQ ID NO: 121587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttctgtgctctgtctgta

SEQ ID NO: 121588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctgtgctctgtctgtat

SEQ ID NO: 121589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctgtgctctgtctgtatg

SEQ ID NO: 121590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgtgctctgtctgtatgt

SEQ ID NO: 121591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtgctctgtctgtatgta

SEQ ID NO: 121592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtgctctgtctgtatgtag

SEQ ID NO: 121593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgctctgtctgtatgtagtc

SEQ ID NO: 121594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtctgtatgtagtcttgtc

SEQ ID NO: 121595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctgtatgtagtcttgtcca

SEQ ID NO: 121596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatgtagtcttgtccacttt

SEQ ID NO: 121597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtccacttttttaatagact

SEQ ID NO: 121598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tccacttttttaatagacta

SEQ ID NO: 121599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttaatagactatcagtgt

SEQ ID NO: 121600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaatagactatcagtgtt

SEQ ID NO: 121601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaatagactatcagtgttt

SEQ ID NO: 121602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatagactatcagtgtttt

SEQ ID NO: 121603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatagactatcagtgtttta

SEQ ID NO: 121604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atagactatcagtgttttat

SEQ ID NO: 121605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcagtgttttattaatttag

SEQ ID NO: 121606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattaatttaggaactctta

SEQ ID NO: 121607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaatttaggaactcttaa

SEQ ID NO: 121608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaatttaggaactcttaac

SEQ ID NO: 121609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttaggaactcttaacaaa

SEQ ID NO: 121610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggaactcttaacaaaataa

SEQ ID NO: 121611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaactcttaacaaaataat

SEQ ID NO: 121612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaacaaaataataaaatta

SEQ ID NO: 121613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacaaaataataaaattagc

SEQ ID NO: 121614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaaaataataaaattagct

SEQ ID NO: 121615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctttttttctgtggtatac

SEQ ID NO: 121616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttctgtggtatacaata

SEQ ID NO: 121617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttctgtggtatacaatac

SEQ ID NO: 121618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctgtggtatacaataca

SEQ ID NO: 121619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctgtggtatacaatacaa

SEQ ID NO: 121620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgtggtatacaatacaaa

SEQ ID NO: 121621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtggtatacaatacaaat

SEQ ID NO: 121622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtggtatacaatacaaata

SEQ ID NO: 121623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggtatacaatacaaatatt

SEQ ID NO: 121624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtaagtttgctgtttttg

SEQ ID NO: 121625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaagtttgctgtttttgt

SEQ ID NO: 121626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaagtttgctgtttttgtt

SEQ ID NO: 121627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagtttgctgtttttgttt

SEQ ID NO: 121628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctgtttttgtttcttttgg

SEQ ID NO: 121629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgtttttgtttcttttggt

SEQ ID NO: 121630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttttgtttcttttggttta

SEQ ID NO: 121631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtttcttttggtttatgg

SEQ ID NO: 121632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtttcttttggtttatggt

SEQ ID NO: 121633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttcttttggtttatggta

SEQ ID NO: 121634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttcttttggtttatggtag

SEQ ID NO: 121635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttggtttatggtagttt

SEQ ID NO: 121636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttggtttatggtagttta

SEQ ID NO: 121637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttggtttatggtagtttatc

SEQ ID NO: 121638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggtttatggtagtttatct

SEQ ID NO: 121639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtttatggtagtttatctt

SEQ ID NO: 121640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtttatggtagtttatcttt

SEQ ID NO: 121641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atggtagtttatcttttaaa

SEQ ID NO: 121642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggtagtttatcttttaaaa

SEQ ID NO: 121643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttttaaaagcatctaca

SEQ ID NO: 121644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttttaaaagcatctacat

SEQ ID NO: 121645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaaagcatctacatttta

SEQ ID NO: 121646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaagcatctacattttaa

SEQ ID NO: 121647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaagcatctacattttaat

SEQ ID NO: 121648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagcatctacattttaatt

SEQ ID NO: 121649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cattttaattaaattgaatt

SEQ ID NO: 121650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattaaattgaattcacca

SEQ ID NO: 121651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattaaattgaattcaccaa

SEQ ID NO: 121652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attaaattgaattcaccaat

SEQ ID NO: 121653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattgaattcaccaatcctt

SEQ ID NO: 121654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattcaccaatcctttctcc

SEQ ID NO: 121655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accaatcctttctccagtgg

SEQ ID NO: 121656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctccagtggctcctgtgtt

SEQ ID NO: 121657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctccagtggctcctgtgttt

SEQ ID NO: 121658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccagtggctcctgtgtttt

SEQ ID NO: 121659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagtggctcctgtgttttat

SEQ ID NO: 121660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgtgttttatattatctta

SEQ ID NO: 121661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgttttatattatcttagaa

SEQ ID NO: 121662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatattatcttagaaaataa

SEQ ID NO: 121663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atattatcttagaaaataat

SEQ ID NO: 121664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattatcttagaaaataatt

SEQ ID NO: 121665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttagaaaataatttctac

SEQ ID NO: 121666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaaaataatttctacttca

SEQ ID NO: 121667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaaataatttctacttcaa

SEQ ID NO: 121668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctacttcaagtacttcataa

SEQ ID NO: 121669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacttcaagtacttcataag

SEQ ID NO: 121670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttcaagtacttcataagtg

SEQ ID NO: 121671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caagtacttcataagtgtga

SEQ ID NO: 121672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagtacttcataagtgtgat

SEQ ID NO: 121673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cataagtgtgatgactgggt

SEQ ID NO: 121674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataagtgtgatgactgggtt

SEQ ID NO: 121675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggttttcacatgcatatgtg

SEQ ID NO: 121676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcacatgcatatgtgagata

SEQ ID NO: 121677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacatgcatatgtgagatat

SEQ ID NO: 121678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acatgcatatgtgagatatt

SEQ ID NO: 121679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctccctcaaaccttgtaatg

SEQ ID NO: 121680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctcaaaccttgtaatgaca

SEQ ID NO: 121681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaccttgtaatgacattga

SEQ ID NO: 121682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaatgacattgatatatta

SEQ ID NO: 121683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatgacattgatatattat

SEQ ID NO: 121684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atatattatccatctcaggt

SEQ ID NO: 121685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccatctcaggtgaaaagaa

SEQ ID NO: 121686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggtgaaaagaaaaaagaaa

SEQ ID NO: 121687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacatgttttcttctagcag

SEQ ID NO: 121688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acatgttttcttctagcagt

SEQ ID NO: 121689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttctagcagttttgtggt

SEQ ID NO: 121690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttctagcagttttgtggtt

SEQ ID NO: 121691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctagcagttttgtggttt

SEQ ID NO: 121692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctagcagttttgtggtttgt

SEQ ID NO: 121693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagcagttttgtggtttgta

SEQ ID NO: 121694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcagttttgtggtttgtatg

SEQ ID NO: 121695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtggtttgtatgttatttt

SEQ ID NO: 121696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtggtttgtatgttatttta

SEQ ID NO: 121697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggtttgtatgttattttaa

SEQ ID NO: 121698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatgttattttaaatattt

SEQ ID NO: 121699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatgttattttaaatatttg

SEQ ID NO: 121700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaaatatttgattccac

SEQ ID NO: 121701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaatatttgattccactaa

SEQ ID NO: 121702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatatttgattccactaaa

SEQ ID NO: 121703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatatttgattccactaaaa

SEQ ID NO: 121704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gattccactaaaatgtatct

SEQ ID NO: 121705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attccactaaaatgtatctt

SEQ ID NO: 121706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cactaaaatgtatcttgggt

SEQ ID NO: 121707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatgtatcttgggttaggt

SEQ ID NO: 121708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gggttaggtggcaaagcagt

SEQ ID NO: 121709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggttaggtggcaaagcagta

SEQ ID NO: 121710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtggcaaagcagtaatctg

SEQ ID NO: 121711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatttatttttatccacatg

SEQ ID NO: 121712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttttatccacatgactac

SEQ ID NO: 121713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttatccacatgactacc

SEQ ID NO: 121714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatccacatgactacccag

SEQ ID NO: 121715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatccacatgactacccagg

SEQ ID NO: 121716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atccacatgactacccaggt

SEQ ID NO: 121717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccacatgactacccaggtg

SEQ ID NO: 121718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cccaggtgtcccaatgataa

SEQ ID NO: 121719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttaaataatatttctttcaa

SEQ ID NO: 121720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataatatttctttcaacct

SEQ ID NO: 121721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcaacctatttaagatg

SEQ ID NO: 121722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcaacctatttaagatgc

SEQ ID NO: 121723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaacctatttaagatgcta

SEQ ID NO: 121724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caacctatttaagatgctac

SEQ ID NO: 121725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacctatttaagatgctacc

SEQ ID NO: 121726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttaagatgctacctttata

SEQ ID NO: 121727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagatgctacctttataatt

SEQ ID NO: 121728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agatgctacctttataattc

SEQ ID NO: 121729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctttataattctcatatgt

SEQ ID NO: 121730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tataattctcatatgtaact

SEQ ID NO: 121731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataattctcatatgtaacta

SEQ ID NO: 121732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taattctcatatgtaactat

SEQ ID NO: 121733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcatatgtaactatgtctat

SEQ ID NO: 121734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atatgtaactatgtctattt

SEQ ID NO: 121735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtctatttctggatatcgt

SEQ ID NO: 121736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttctggatatcgtattttc

SEQ ID NO: 121737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctggatatcgtattttcttc

SEQ ID NO: 121738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggatatcgtattttcttcc

SEQ ID NO: 121739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatatcgtattttcttccaa

SEQ ID NO: 121740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttccaatgaactatctat

SEQ ID NO: 121741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttccaatgaactatctatg

SEQ ID NO: 121742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttccaatgaactatctatgt

SEQ ID NO: 121743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaatgaactatctatgtag

SEQ ID NO: 121744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caatgaactatctatgtagg

SEQ ID NO: 121745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctatgtaggtcaccatact

SEQ ID NO: 121746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtaggtcaccatactattt

SEQ ID NO: 121747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttaattaccctatttgca

SEQ ID NO: 121748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattaccctatttgcataa

SEQ ID NO: 121749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattaccctatttgcataaa

SEQ ID NO: 121750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attaccctatttgcataaaa

SEQ ID NO: 121751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccctatttgcataaaataac

SEQ ID NO: 121752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttgcataaaataacattat

SEQ ID NO: 121753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcataaaataacattatgta

SEQ ID NO: 121754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cataaaataacattatgtat

SEQ ID NO: 121755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtattagggttggtgctat

SEQ ID NO: 121756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gggttggtgctattagatat

SEQ ID NO: 121757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgctattagatattactct

SEQ ID NO: 121758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttagatattactcttttatg

SEQ ID NO: 121759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatattactcttttatgtgt

SEQ ID NO: 121760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcttttatgtgtgtacaat

SEQ ID NO: 121761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttatgtgtgtacaatttc

SEQ ID NO: 121762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatgtgtgtacaatttccc

SEQ ID NO: 121763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgtgtgtacaatttccca

SEQ ID NO: 121764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgtgtgtacaatttcccaa

SEQ ID NO: 121765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtgtgtacaatttcccaac

SEQ ID NO: 121766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccaactagatccagattat

SEQ ID NO: 121767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaactagatccagattatc

SEQ ID NO: 121768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatccagattatctaattcc

SEQ ID NO: 121769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctaattccaaatgggaaaa

SEQ ID NO: 121770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attccaaatgggaaaatttc

SEQ ID NO: 121771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaatgggaaaatttctatt

SEQ ID NO: 121772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatttttattttcattggg

SEQ ID NO: 121773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatttttattttcattggga

SEQ ID NO: 121774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttttattttcattgggatt

SEQ ID NO: 121775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattttcattgggattgca

SEQ ID NO: 121776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttcattgggattgcaa

SEQ ID NO: 121777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttcattgggattgcaat

SEQ ID NO: 121778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcattgggattgcaatg

SEQ ID NO: 121779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattgggattgcaatgtct

SEQ ID NO: 121780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattgggattgcaatgtctt

SEQ ID NO: 121781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attgggattgcaatgtcttt

SEQ ID NO: 121782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggattgcaatgtctttataa

SEQ ID NO: 121783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caatgtctttataaattaaa

SEQ ID NO: 121784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tataaattaaaaggttaaaa

SEQ ID NO: 121785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataaattaaaaggttaaaag

SEQ ID NO: 121786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaattaaaaggttaaaagg

SEQ ID NO: 121787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaggttaaaaggaactgcc

SEQ ID NO: 121788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaggaactgccaatggtaa

SEQ ID NO: 121789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccaatggtaagcactctgac

SEQ ID NO: 121790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgactctttttttaatacct

SEQ ID NO: 121791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actctttttttaatacctct

SEQ ID NO: 121792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttttttaatacctcttctt

SEQ ID NO: 121793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttaatacctcttcttta

SEQ ID NO: 121794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaatacctcttctttag

SEQ ID NO: 121795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaatacctcttctttaga

SEQ ID NO: 121796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaatacctcttctttagat

SEQ ID NO: 121797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatacctcttctttagatt

SEQ ID NO: 121798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatacctcttctttagatta

SEQ ID NO: 121799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atacctcttctttagattat

SEQ ID NO: 121800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttctttagattataaaaaca

SEQ ID NO: 121801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttagattataaaaacaaa

SEQ ID NO: 121802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttagattataaaaacaaag

SEQ ID NO: 121803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagattataaaaacaaagta

SEQ ID NO: 121804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agattataaaaacaaagtat

SEQ ID NO: 121805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gattataaaaacaaagtatg

SEQ ID NO: 121806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaaaacaaagtatgccaag

SEQ ID NO: 121807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctactcattttagaacctc

SEQ ID NO: 121808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcattttagaacctctaat

SEQ ID NO: 121809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attttagaacctctaatgtt

SEQ ID NO: 121810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagaacctctaatgttaagt

SEQ ID NO: 121811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaacctctaatgttaagtg

SEQ ID NO: 121812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaacctctaatgttaagtgt

SEQ ID NO: 121813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taatgttaagtgtatcaata

SEQ ID NO: 121814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgttaagtgtatcaatata

SEQ ID NO: 121815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtgtatcaatatatatgaa

SEQ ID NO: 121816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcattaaatacttgcctga

SEQ ID NO: 121817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattaaatacttgcctgat

SEQ ID NO: 121818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattaaatacttgcctgatt

SEQ ID NO: 121819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attaaatacttgcctgattg

SEQ ID NO: 121820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatacttgcctgattgctga

SEQ ID NO: 121821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcctgattgctgaaatctta

SEQ ID NO: 121822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctgattgctgaaatcttac

SEQ ID NO: 121823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attgctgaaatcttaccatt

SEQ ID NO: 121824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgaaatcttaccattgcat

SEQ ID NO: 121825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaatcttaccattgcatcct

SEQ ID NO: 121826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
accattgcatccttcataag

SEQ ID NO: 121827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccattgcatccttcataagt

SEQ ID NO: 121828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catccttcataagtaacatt

SEQ ID NO: 121829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cataagtaacattatgttaa

SEQ ID NO: 121830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataagtaacattatgttaat

SEQ ID NO: 121831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgttaatcatgtaaataaat

SEQ ID NO: 121832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcatgtaaataaattctta

SEQ ID NO: 121833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaaaataattattatttct

SEQ ID NO: 121834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaataattattatttctta

SEQ ID NO: 121835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaataattattatttcttag

SEQ ID NO: 121836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatttcttagaaatgctta

SEQ ID NO: 121837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcttagaaatgcttaatt

SEQ ID NO: 121838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttagaaatgcttaatttgg

SEQ ID NO: 121839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttagaaatgcttaatttggt

SEQ ID NO: 121840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaaatgcttaatttggtag

SEQ ID NO: 121841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaatgcttaatttggtaga

SEQ ID NO: 121842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatttggtagatggcaaatc

SEQ ID NO: 121843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttggtagatggcaaatca

SEQ ID NO: 121844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtagatggcaaatcagttt

SEQ ID NO: 121845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtagatggcaaatcagttta

SEQ ID NO: 121846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aataacttcaacaagagtag

SEQ ID NO: 121847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataacttcaacaagagtagt

SEQ ID NO: 121848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caacaagagtagttcaatat

SEQ ID NO: 121849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacaagagtagttcaatatt

SEQ ID NO: 121850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatatttcatgtcctaaaat

SEQ ID NO: 121851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgtcctaaaatcattcaa

SEQ ID NO: 121852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtcctaaaatcattcaat

SEQ ID NO: 121853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatcattcaattttatggc

SEQ ID NO: 121854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aattttatggcattttatag

SEQ ID NO: 121855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatggcattttatagtagtt

SEQ ID NO: 121856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atggcattttatagtagttg

SEQ ID NO: 121857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggcattttatagtagttga

SEQ ID NO: 121858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatagtagttgaacaactgg

SEQ ID NO: 121859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagtagttgaacaactggt

SEQ ID NO: 121860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagtagttgaacaactggta

SEQ ID NO: 121861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacaactggtatgcaaaaca

SEQ ID NO: 121862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtatgcaaaacaaattaagc

SEQ ID NO: 121863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agctgtatatgcgataattt

SEQ ID NO: 121864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatatgcgataattttatat

SEQ ID NO: 121865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatattcagacaactgatag

SEQ ID NO: 121866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atattcagacaactgatagg

SEQ ID NO: 121867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattcagacaactgataggg

SEQ ID NO: 121868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agacaactgatagggactat

SEQ ID NO: 121869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atagggactatttctaaatt

SEQ ID NO: 121870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttctaaattctatgattat

SEQ ID NO: 121871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaaattctatgattattaa

SEQ ID NO: 121872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaattctatgattattaaa

SEQ ID NO: 121873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattctatgattattaaaat

SEQ ID NO: 121874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatgattattaaaatattgt

SEQ ID NO: 121875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgattattaaaatattgtga

SEQ ID NO: 121876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaaatattgtgatttggg

SEQ ID NO: 121877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatattgtgatttgggtat

SEQ ID NO: 121878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgatttgggtatttcataat

SEQ ID NO: 121879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggtatttcataataccctg

SEQ ID NO: 121880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggtatttcataataccctgt

SEQ ID NO: 121881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cataataccctgtaataatc

SEQ ID NO: 121882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataataccctgtaataatca

SEQ ID NO: 121883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taataatcatttatattata

SEQ ID NO: 121884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atattatatttattatttta

SEQ ID NO: 121885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattatatttattattttat

SEQ ID NO: 121886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatttattattttattatta

SEQ ID NO: 121887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attattttattattaagata

SEQ ID NO: 121888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattttattattaagatag

SEQ ID NO: 121889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttattattaagatagaag

SEQ ID NO: 121890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattattaagatagaagtta

SEQ ID NO: 121891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attattaagatagaagttag

SEQ ID NO: 121892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattaagatagaagttagt

SEQ ID NO: 121893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaagatagaagttagtctt

SEQ ID NO: 121894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agatagaagttagtcttatg

SEQ ID NO: 121895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtcttatgtatagcctttta

SEQ ID NO: 121896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgtatagccttttaaaata

SEQ ID NO: 121897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtatagccttttaaaatat

SEQ ID NO: 121898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaaatatagtattcctca

SEQ ID NO: 121899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaatatagtattcctcaa

SEQ ID NO: 121900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatatagtattcctcaag

SEQ ID NO: 121901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatatagtattcctcaagt

SEQ ID NO: 121902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcaagtttataagaaatga

SEQ ID NO: 121903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagtttataagaaatgaaag

SEQ ID NO: 121904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataagaaatgaaagtttgcc

SEQ ID NO: 121905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taagaaatgaaagtttgccg

SEQ ID NO: 121906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccgggcgtggtggctcacg

SEQ ID NO: 121907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccgggcgtggtggctcacgc

SEQ ID NO: 121908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acgcctataatcccagcact

SEQ ID NO: 121909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatcccagcactttgggaa

SEQ ID NO: 121910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgggaagccgaggcaggcgg

SEQ ID NO: 121911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggaagccgaggcaggcgga

SEQ ID NO: 121912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaagccgaggcaggcggat

SEQ ID NO: 121913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggtcaggaattcaagacca

SEQ ID NO: 121914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagaccagcctgaccaacat

SEQ ID NO: 121915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
accaacatggagaaaccccg

SEQ ID NO: 121916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tactaaaaatacaaaattag

SEQ ID NO: 121917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaaaaatacaaaattagct

SEQ ID NO: 121918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaatacaaaattagctggt

SEQ ID NO: 121919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctggtcatggtggcgcatg

SEQ ID NO: 121920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtcatggtggcgcatgcctg

SEQ ID NO: 121921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taatcccagctactcaggag

SEQ ID NO: 121922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcaggaggctgaggcagga

SEQ ID NO: 121923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggaggctgaggcaggagaa

SEQ ID NO: 121924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggcaggagaactgcttgaa

SEQ ID NO: 121925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttgaacccgggaggtggat

SEQ ID NO: 121926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaacccgggaggtggattgt

SEQ ID NO: 121927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacccgggaggtggattgta

SEQ ID NO: 121928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagtgagctgagatcgggcc

SEQ ID NO: 121929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agatcgggccattgcactcc

SEQ ID NO: 121930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cactccagcctgggcaacaa

SEQ ID NO: 121931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagcctgggcaacaagagcg

SEQ ID NO: 121932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcaacaagagcgaaactct

SEQ ID NO: 121933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtctcaaaaaaaaaaaaaa

SEQ ID NO: 121934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctcaaaaaaaaaaaaaaaa

SEQ ID NO: 121935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaaaaaaaaaaaaaagaaa

SEQ ID NO: 121936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtttataatcttaagaag

SEQ ID NO: 121937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataatcttaagaagtgtatt

SEQ ID NO: 121938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatcttaagaagtgtatta

SEQ ID NO: 121939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagaagtgtattaccctggg

SEQ ID NO: 121940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaagtgtattaccctggga

SEQ ID NO: 121941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccctgggaaaacttaagatt

SEQ ID NO: 121942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaaaacttaagattagtgt

SEQ ID NO: 121943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagattagtgtcaacatttg

SEQ ID NO: 121944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agattagtgtcaacatttgc

SEQ ID NO: 121945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgtcaacatttgctggcat

SEQ ID NO: 121946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctggcatatctgaacgttt

SEQ ID NO: 121947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctggcatatctgaacgtttt

SEQ ID NO: 121948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcatatctgaacgttttaat

SEQ ID NO: 121949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacgttttaataaaaaattc

SEQ ID NO: 121950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taataaaaaattcataaagt

SEQ ID NO: 121951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aataaaaaattcataaagtc

SEQ ID NO: 121952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataaaaaattcataaagtct

SEQ ID NO: 121953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataaagtcttatctgtacag

SEQ ID NO: 121954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atctgtacagcatgtataaa

SEQ ID NO: 121955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgtacagcatgtataaag

SEQ ID NO: 121956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tacagcatgtataaaggaag

SEQ ID NO: 121957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttagttcacgttaaatccc

SEQ ID NO: 121958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttagttcacgttaaatccca

SEQ ID NO: 121959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agttcacgttaaatcccatc

SEQ ID NO: 121960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttcacgttaaatcccatct

SEQ ID NO: 121961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acgttaaatcccatctctct

SEQ ID NO: 121962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatcccatctctctgttagt

SEQ ID NO: 121963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctgttagttaagactttat

SEQ ID NO: 121964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgttagttaagactttattg

SEQ ID NO: 121965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttagttaagactttattgag

SEQ ID NO: 121966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttaagactttattgagagc

SEQ ID NO: 121967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agactttattgagagcacaa

SEQ ID NO: 121968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattgagagcacaaaattat

SEQ ID NO: 121969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgagagcacaaaattatc

SEQ ID NO: 121970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgagagcacaaaattatca

SEQ ID NO: 121971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agagcacaaaattatcacag

SEQ ID NO: 121972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcacagacttatggctgcag

SEQ ID NO: 121973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atggctgcagaacaggttct

SEQ ID NO: 121974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggctgcagaacaggttcta

SEQ ID NO: 121975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagaacaggttctataccct

SEQ ID NO: 121976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatacccttatttaaataat

SEQ ID NO: 121977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tacccttatttaaataatta

SEQ ID NO: 121978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttaaataattagagagaa

SEQ ID NO: 121979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaaataattagagagaaa

SEQ ID NO: 121980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaataattagagagaaaatg

SEQ ID NO: 121981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataattagagagaaaatgt

SEQ ID NO: 121982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagagaaaatgtatttccaa

SEQ ID NO: 121983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaatattattatacatgta

SEQ ID NO: 121984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caatattattatacatgtat

SEQ ID NO: 121985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatacatgtatccacttcc

SEQ ID NO: 121986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacatgtatccacttccctc

SEQ ID NO: 121987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctcaaaacatcaacatga

SEQ ID NO: 121988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctcaaaacatcaacatgat

SEQ ID NO: 121989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaacatcaacatgatttag

SEQ ID NO: 121990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggagaaagtgcatagtaat

SEQ ID NO: 121991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggagaaagtgcatagtaata

SEQ ID NO: 121992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggcaccaggcagacttagg

SEQ ID NO: 121993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcaccaggcagacttaggt

SEQ ID NO: 121994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcaccaggcagacttaggtt

SEQ ID NO: 121995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aggtttgaatttcctgttta

SEQ ID NO: 121996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtttgaatttcctgtttat

SEQ ID NO: 121997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaatttcctgtttattccat

SEQ ID NO: 121998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatttcctgtttattccata

SEQ ID NO: 121999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgtttattccatataatt

SEQ ID NO: 122000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgtttattccatataatta

SEQ ID NO: 122001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttattccatataattagct

SEQ ID NO: 122002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attccatataattagctctg

SEQ ID NO: 122003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttccatataattagctctgc

SEQ ID NO: 122004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catataattagctctgcagc

SEQ ID NO: 122005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctctgcagcattatgcaaa

SEQ ID NO: 122006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcagcattatgcaaattcc

SEQ ID NO: 122007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagcattatgcaaattcccc

SEQ ID NO: 122008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcaaattccccataaatga

SEQ ID NO: 122009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccataaatgaaagagagaa

SEQ ID NO: 122010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcttataaagttatcatgta

SEQ ID NO: 122011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataaagttatcatgtagaat

SEQ ID NO: 122012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaagttatcatgtagaata

SEQ ID NO: 122013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcatgtagaatagaaatggt

SEQ ID NO: 122014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggtaaagtgcctaccacag

SEQ ID NO: 122015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtaaagtgcctaccacagt

SEQ ID NO: 122016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtaaagtgcctaccacagtg

SEQ ID NO: 122017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccacagtgcctaggctaaat

SEQ ID NO: 122018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggctaaataaataacagcaa

SEQ ID NO: 122019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aataaataacagcaagatta

SEQ ID NO: 122020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatccttcttccctataca

SEQ ID NO: 122021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccttcttccctatacagac

SEQ ID NO: 122022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttccctatacagactgaaa

SEQ ID NO: 122023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttccctatacagactgaaat

SEQ ID NO: 122024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctatacagactgaaattt

SEQ ID NO: 122025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctatacagactgaaatttt

SEQ ID NO: 122026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tacagactgaaatttttaaa

SEQ ID NO: 122027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaatttttaaataataagcc

SEQ ID NO: 122028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaataataagccatgagt

SEQ ID NO: 122029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaataataagccatgagtt

SEQ ID NO: 122030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaataataagccatgagttg

SEQ ID NO: 122031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataataagccatgagttgg

SEQ ID NO: 122032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gccaataaacacaaaacctt

SEQ ID NO: 122033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acgaaaatcttatgtggagt

SEQ ID NO: 122034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cgaaaatcttatgtggagta

SEQ ID NO: 122035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgtggagtatatttgttac

SEQ ID NO: 122036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtggagtatatttgttacc

SEQ ID NO: 122037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttacctatgttttatcttg

SEQ ID NO: 122038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttacctatgttttatcttgc

SEQ ID NO: 122039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctatgttttatcttgccaa

SEQ ID NO: 122040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgttttatcttgccaaacat

SEQ ID NO: 122041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcttgccaaacatgttta

SEQ ID NO: 122042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttgccaaacatgtttat

SEQ ID NO: 122043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttgccaaacatgtttatg

SEQ ID NO: 122044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gccaaacatgtttatggctt

SEQ ID NO: 122045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccaaacatgtttatggcttt

SEQ ID NO: 122046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atggctttaatttaaaatat

SEQ ID NO: 122047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggctttaatttaaaatata

SEQ ID NO: 122048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taatttaaaatatagatctg

SEQ ID NO: 122049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttaaaatatagatctgc

SEQ ID NO: 122050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttaaaatatagatctgca

SEQ ID NO: 122051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatatagatctgcagtaa

SEQ ID NO: 122052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatatagatctgcagtaaa

SEQ ID NO: 122053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagtaaaatagtaagacagc

SEQ ID NO: 122054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaaattcatggctccagag

SEQ ID NO: 122055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattcatggctccagagtga

SEQ ID NO: 122056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atggctccagagtgagagag

SEQ ID NO: 122057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagagtgagagaggcatggg

SEQ ID NO: 122058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acatcccatctctactgctt

SEQ ID NO: 122059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tactgcttactagcttatgt

SEQ ID NO: 122060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgcttactagcttatgtcc

SEQ ID NO: 122061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttactagcttatgtccttg

SEQ ID NO: 122062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actagcttatgtccttgggg

SEQ ID NO: 122063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctagcttatgtccttgggga

SEQ ID NO: 122064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcttatgtccttggggaatt

SEQ ID NO: 122065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgtccttggggaatttaat

SEQ ID NO: 122066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtccttggggaatttaatt

SEQ ID NO: 122067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggggaatttaattaacttct

SEQ ID NO: 122068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggaatttaattaacttctc

SEQ ID NO: 122069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattaacttctctaaagctc

SEQ ID NO: 122070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attaacttctctaaagctca

SEQ ID NO: 122071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acttctctaaagctcagttc

SEQ ID NO: 122072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctctaaagctcagttcttat

SEQ ID NO: 122073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctaaagctcagttcttata

SEQ ID NO: 122074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taaagctcagttcttatata

SEQ ID NO: 122075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagctcagttcttatatagc

SEQ ID NO: 122076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agttcttatatagcaaaccg

SEQ ID NO: 122077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatatagcaaaccggagct

SEQ ID NO: 122078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atatagcaaaccggagctga

SEQ ID NO: 122079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatagcaaaccggagctgaa

SEQ ID NO: 122080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaatgataatcctttaagg

SEQ ID NO: 122081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaggttattttagtggaaa

SEQ ID NO: 122082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaggttattttagtggaaaa

SEQ ID NO: 122083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggttattttagtggaaaaa

SEQ ID NO: 122084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttagtggaaaaaattaga

SEQ ID NO: 122085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagtggaaaaaattagacac

SEQ ID NO: 122086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtggaaaaaattagacact

SEQ ID NO: 122087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtggaaaaaattagacactg

SEQ ID NO: 122088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gacactgaattttaataact

SEQ ID NO: 122089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aattttaataacttagcaca

SEQ ID NO: 122090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taataacttagcacatttcc

SEQ ID NO: 122091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aataacttagcacatttcct

SEQ ID NO: 122092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataacttagcacatttcctg

SEQ ID NO: 122093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agcacatttcctgttacact

SEQ ID NO: 122094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcacatttcctgttacactt

SEQ ID NO: 122095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgttacactttcagtgca

SEQ ID NO: 122096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgttacactttcagtgcac

SEQ ID NO: 122097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttacactttcagtgcacaat

SEQ ID NO: 122098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cactttcagtgcacaataca

SEQ ID NO: 122099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcagtgcacaatacattgta

SEQ ID NO: 122100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagtgcacaatacattgtaa

SEQ ID NO: 122101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtgcacaatacattgtaac

SEQ ID NO: 122102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taactgttattattagtgat

SEQ ID NO: 122103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttattattagtgattttagc

SEQ ID NO: 122104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattagtgattttagcaac

SEQ ID NO: 122105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttagtgattttagcaacttt

SEQ ID NO: 122106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgattttagcaactttctt

SEQ ID NO: 122107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagcaactttcttctaagtt

SEQ ID NO: 122108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcaactttcttctaagttg

SEQ ID NO: 122109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaactttcttctaagttga

SEQ ID NO: 122110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttctaagttgattttgta

SEQ ID NO: 122111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttctaagttgattttgtat

SEQ ID NO: 122112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctaagttgattttgtata

SEQ ID NO: 122113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaagttgattttgtatacc

SEQ ID NO: 122114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taagttgattttgtatacct

SEQ ID NO: 122115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agttgattttgtatacctaa

SEQ ID NO: 122116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attttgtatacctaaagcta

SEQ ID NO: 122117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtatacctaaagctaatgt

SEQ ID NO: 122118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatacctaaagctaatgtt

SEQ ID NO: 122119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatacctaaagctaatgttc

SEQ ID NO: 122120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagctaatgttcttaggaac

SEQ ID NO: 122121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgttcttaggaacgagaat

SEQ ID NO: 122122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaggaacgagaatatattt

SEQ ID NO: 122123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aggaacgagaatatatttgc

SEQ ID NO: 122124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaacgagaatatatttgct

SEQ ID NO: 122125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttactttataatagaaaa

SEQ ID NO: 122126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttactttataatagaaaag

SEQ ID NO: 122127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actttataatagaaaagctt

SEQ ID NO: 122128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttataatagaaaagcttt

SEQ ID NO: 122129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tataatagaaaagcttttgt

SEQ ID NO: 122130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataatagaaaagcttttgta

SEQ ID NO: 122131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatagaaaagcttttgtat

SEQ ID NO: 122132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgtattgcatatacaaaac

SEQ ID NO: 122133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtattgcatatacaaaacc

SEQ ID NO: 122134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtattgcatatacaaaacct

SEQ ID NO: 122135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattgcatatacaaaacctt

SEQ ID NO: 122136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catatacaaaaccttttctt

SEQ ID NO: 122137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcttcttagggagctttca

SEQ ID NO: 122138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttcttagggagctttcaa

SEQ ID NO: 122139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcttagggagctttcaac

SEQ ID NO: 122140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcttagggagctttcaact

SEQ ID NO: 122141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttagggagctttcaactca

SEQ ID NO: 122142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttagggagctttcaactcag

SEQ ID NO: 122143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agggagctttcaactcagaa

SEQ ID NO: 122144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gggagctttcaactcagaat

SEQ ID NO: 122145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaactcagaatattttaaa

SEQ ID NO: 122146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caactcagaatattttaaag

SEQ ID NO: 122147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aactcagaatattttaaaga

SEQ ID NO: 122148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaatattttaaagactaaa

SEQ ID NO: 122149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaagactaaaatgtatgct

SEQ ID NO: 122150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagactaaaatgtatgctt

SEQ ID NO: 122151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagactaaaatgtatgctta

SEQ ID NO: 122152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatgtatgcttatagcaaa

SEQ ID NO: 122153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atagcaaaaccaagactaca

SEQ ID NO: 122154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagcaaaaccaagactacat

SEQ ID NO: 122155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cattgccttctaccaacagg

SEQ ID NO: 122156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccttctaccaacaggtggca

SEQ ID NO: 122157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaccaacaggtggcaatat

SEQ ID NO: 122158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taccaacaggtggcaatata

SEQ ID NO: 122159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccaacaggtggcaatatatg

SEQ ID NO: 122160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagtcctgccaatacaaagt

SEQ ID NO: 122161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtcctgccaatacaaagtt

SEQ ID NO: 122162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtcctgccaatacaaagttc

SEQ ID NO: 122163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccaatacaaagttcattagt

SEQ ID NO: 122164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attagtttattcagtgtcta

SEQ ID NO: 122165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtttattcagtgtctacagg

SEQ ID NO: 122166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attcagtgtctacaggatgt

SEQ ID NO: 122167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcagtgtctacaggatgtg

SEQ ID NO: 122168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtgtctacaggatgtgggc

SEQ ID NO: 122169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caggatgtgggccttgcttt

SEQ ID NO: 122170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctttcaaggttatataaat

SEQ ID NO: 122171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttcaaggttatataaatt

SEQ ID NO: 122172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaaggttatataaattctt

SEQ ID NO: 122173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaggttatataaattctta

SEQ ID NO: 122174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaggttatataaattcttaa

SEQ ID NO: 122175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tataaattcttaaatccatc

SEQ ID NO: 122176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaaatccatcaggtttgat

SEQ ID NO: 122177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaatccatcaggtttgataa

SEQ ID NO: 122178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatccatcaggtttgataaa

SEQ ID NO: 122179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gataaatgtggatacactga

SEQ ID NO: 122180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataaatgtggatacactgaa

SEQ ID NO: 122181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacacaccgaggatgttgaa

SEQ ID NO: 122182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaagatttaataacaaaaac

SEQ ID NO: 122183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aataacaaaaacattggaat

SEQ ID NO: 122184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataacaaaaacattggaata

SEQ ID NO: 122185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaatatcatgggaaccaaag

SEQ ID NO: 122186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatcattgacagtaatgatg

SEQ ID NO: 122187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcattgacagtaatgatga

SEQ ID NO: 122188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acagtaatgatgaccctcta

SEQ ID NO: 122189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taggactgagcagaattatg

SEQ ID NO: 122190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggactgagcagaattatgca

SEQ ID NO: 122191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agcagaattatgcaaaagtt

SEQ ID NO: 122192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcaaaagtttaaaataatg

SEQ ID NO: 122193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaataatgagcttaggcaa

SEQ ID NO: 122194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaataatgagcttaggcaat

SEQ ID NO: 122195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aggcaatagccagcaagata

SEQ ID NO: 122196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggcaatagccagcaagatac

SEQ ID NO: 122197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttttttaaaaaaatgaaaa

SEQ ID NO: 122198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaaaaaaatgaaaatgc

SEQ ID NO: 122199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaaaaaatgaaaatgct

SEQ ID NO: 122200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaaaaatgaaaatgctc

SEQ ID NO: 122201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaaaatgaaaatgctct

SEQ ID NO: 122202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaaatgaaaatgctcta

SEQ ID NO: 122203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaatgaaaatgctctag

SEQ ID NO: 122204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagcatgagtcagaggattt

SEQ ID NO: 122205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcatgagtcagaggattttt

SEQ ID NO: 122206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcattagcagcggatgctc

SEQ ID NO: 122207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattagcagcggatgctcc

SEQ ID NO: 122208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattagcagcggatgctcca

SEQ ID NO: 122209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attagcagcggatgctccag

SEQ ID NO: 122210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcagcggatgctccagaact

SEQ ID NO: 122211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagaacttaatgctaaagtg

SEQ ID NO: 122212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatgctaaagtgagaaaaga

SEQ ID NO: 122213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgctaaagtgagaaaagac

SEQ ID NO: 122214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtgagaaaagactaggta

SEQ ID NO: 122215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtattcattcaagaaggca

SEQ ID NO: 122216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attcaagaaggcaaaatcca

SEQ ID NO: 122217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagaaggcaaaatccaagca

SEQ ID NO: 122218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctgatgaaatattcctgatg

SEQ ID NO: 122219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgaaatattcctgatgggg

SEQ ID NO: 122220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgatggggcaggaattgtt

SEQ ID NO: 122221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atggggcaggaattgttaaa

SEQ ID NO: 122222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaaaagccctttaattcaa

SEQ ID NO: 122223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagccctttaattcaatat

SEQ ID NO: 122224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taattcaatatcaaaataag

SEQ ID NO: 122225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattcaatatcaaaataagt

SEQ ID NO: 122226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attcaatatcaaaataagtg

SEQ ID NO: 122227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatatcaaaataagtgagtt

SEQ ID NO: 122228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaagcatgcatgccaaagt

SEQ ID NO: 122229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttggaacatttgtggacat

SEQ ID NO: 122230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggaacatttgtggacattg

SEQ ID NO: 122231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaacatttgtggacattgt

SEQ ID NO: 122232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaacatttgtggacattgtc

SEQ ID NO: 122233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtggacattgtcaaaactag

SEQ ID NO: 122234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggacattgtcaaaactagt

SEQ ID NO: 122235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaaaactagtgacatctac

SEQ ID NO: 122236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtgacatctactcataagat

SEQ ID NO: 122237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcataagatttttgatgaa

SEQ ID NO: 122238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataagatttttgatgaagac

SEQ ID NO: 122239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgatgaagacattgtttga

SEQ ID NO: 122240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgatgaagacattgtttgag

SEQ ID NO: 122241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatgaagacattgtttgaga

SEQ ID NO: 122242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgaagacattgtttgagaa

SEQ ID NO: 122243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgagaatctatattagca

SEQ ID NO: 122244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagaatctatattagcaaag

SEQ ID NO: 122245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaatctatattagcaaagg

SEQ ID NO: 122246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tattagcaaaggaagggggt

SEQ ID NO: 122247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaaaggaagggggtaatct

SEQ ID NO: 122248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtttgaggagtctaaaggaa

SEQ ID NO: 122249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaggagtctaaaggaacagt

SEQ ID NO: 122250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggagtctaaaggaacagtt

SEQ ID NO: 122251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaggaacagtttatttagtg

SEQ ID NO: 122252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttagtggaaattcatctg

SEQ ID NO: 122253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttagtggaaattcatctgg

SEQ ID NO: 122254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtggaaattcatctggaga

SEQ ID NO: 122255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtggaaattcatctggagat

SEQ ID NO: 122256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atctggagatggtaaagtac

SEQ ID NO: 122257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagatggtaaagtactatgg

SEQ ID NO: 122258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggtataaataacatgagtt

SEQ ID NO: 122259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actaacaaaccttttgcaaa

SEQ ID NO: 122260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaacaaaccttttgcaaac

SEQ ID NO: 122261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acaaaccttttgcaaactaa

SEQ ID NO: 122262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgcaaactaacatgttcat

SEQ ID NO: 122263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcaaactaacatgttcata

SEQ ID NO: 122264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaaactaacatgttcatag

SEQ ID NO: 122265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaactaacatgttcataga

SEQ ID NO: 122266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acatgttcatagatatgact

SEQ ID NO: 122267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atagatatgacttcctgtgt

SEQ ID NO: 122268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctgtgtttcttatttctct

SEQ ID NO: 122269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgtgtttcttatttctctg

SEQ ID NO: 122270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtttcttatttctctgctc

SEQ ID NO: 122271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttatttctctgctctctct

SEQ ID NO: 122272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatttctctgctctctctt

SEQ ID NO: 122273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttctctgctctctcttgg

SEQ ID NO: 122274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttctctgctctctcttgga

SEQ ID NO: 122275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctgctctctcttggaact

SEQ ID NO: 122276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgctctctcttggaacta

SEQ ID NO: 122277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgctctctcttggaactaaa

SEQ ID NO: 122278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctctctcttggaactaaagg

SEQ ID NO: 122279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctcttggaactaaaggctg

SEQ ID NO: 122280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcttggaactaaaggctgtg

SEQ ID NO: 122281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttggaactaaaggctgtgat

SEQ ID NO: 122282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaactaaaggctgtgatta

SEQ ID NO: 122283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaactaaaggctgtgattat

SEQ ID NO: 122284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaggctgtgattatggcaag

SEQ ID NO: 122285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgattatggcaaggtatcta

SEQ ID NO: 122286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggcaaggtatctaggaacc

SEQ ID NO: 122287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggaaccctcaccataatctg

SEQ ID NO: 122288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
accataatctgggaatatga

SEQ ID NO: 122289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaatatgatgaaactcatg

SEQ ID NO: 122290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgtgatattgtttaaaatg

SEQ ID NO: 122291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttaaaatgcattctctttc

SEQ ID NO: 122292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatgcattctctttctgt

SEQ ID NO: 122293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgcattctctttctgtt

SEQ ID NO: 122294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctttctgttgttgttgtta

SEQ ID NO: 122295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttctgttgttgttgttaaa

SEQ ID NO: 122296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctgttgttgttgttaaaaa

SEQ ID NO: 122297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgttgttgttgttaaaaat

SEQ ID NO: 122298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttgttgttgttaaaaata

SEQ ID NO: 122299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgttgttgttaaaaatata

SEQ ID NO: 122300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgttgttaaaaatatattc

SEQ ID NO: 122301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgttaaaaatatattcaaa

SEQ ID NO: 122302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaaaaatatattcaaagat

SEQ ID NO: 122303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatatattcaaagataaa

SEQ ID NO: 122304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaagataaagggtatggcta

SEQ ID NO: 122305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttttttaagggtgaattaa

SEQ ID NO: 122306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaagggtgaattaaatg

SEQ ID NO: 122307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaagggtgaattaaatgt

SEQ ID NO: 122308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaagggtgaattaaatgtg

SEQ ID NO: 122309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagggtgaattaaatgtgt

SEQ ID NO: 122310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagggtgaattaaatgtgtg

SEQ ID NO: 122311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agggtgaattaaatgtgtga

SEQ ID NO: 122312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgtgtgatagtatttctt

SEQ ID NO: 122313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttactttctgccattttgg

SEQ ID NO: 122314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttactttctgccattttggg

SEQ ID NO: 122315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actttctgccattttggggc

SEQ ID NO: 122316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttctgccattttggggca

SEQ ID NO: 122317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctgccattttggggcagaa

SEQ ID NO: 122318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgccattttggggcagaat

SEQ ID NO: 122319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgccattttggggcagaatt

SEQ ID NO: 122320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccattttggggcagaatttt

SEQ ID NO: 122321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggggcagaattttcagaac

SEQ ID NO: 122322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggggcagaattttcagaacc

SEQ ID NO: 122323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggcagaattttcagaacct

SEQ ID NO: 122324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagaacctcacagatataa

SEQ ID NO: 122325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagaacctcacagatataaa

SEQ ID NO: 122326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaacctcacagatataaat

SEQ ID NO: 122327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acagatataaataggattgg

SEQ ID NO: 122328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagtcatgaagaatattcca

SEQ ID NO: 122329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaattagataacaatcaca

SEQ ID NO: 122330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gataacaatcacaggatcac

SEQ ID NO: 122331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctatccttcctcaaatttat

SEQ ID NO: 122332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tccttcctcaaatttatatt

SEQ ID NO: 122333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctcaaatttatattccaga

SEQ ID NO: 122334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcaaatttatattccagaa

SEQ ID NO: 122335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaatttatattccagaagga

SEQ ID NO: 122336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atattccagaaggaagtgtt

SEQ ID NO: 122337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattccagaaggaagtgttt

SEQ ID NO: 122338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagaaggaagtgttttgcct

SEQ ID NO: 122339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcctaaacatttgctttat

SEQ ID NO: 122340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcctaaacatttgctttatc

SEQ ID NO: 122341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctaaacatttgctttatct

SEQ ID NO: 122342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacatttgctttatctcaga

SEQ ID NO: 122343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctttatctcagaatccaag

SEQ ID NO: 122344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttatctcagaatccaaga

SEQ ID NO: 122345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatctcagaatccaagactc

SEQ ID NO: 122346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctcagaatccaagactcc

SEQ ID NO: 122347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctcagaatccaagactcct

SEQ ID NO: 122348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaatccaagactcctgatc

SEQ ID NO: 122349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgatcaaatttatattcca

SEQ ID NO: 122350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atcaaatttatattccagaa

SEQ ID NO: 122351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atattccagaaggaattaaa

SEQ ID NO: 122352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattccagaaggaattaaaa

SEQ ID NO: 122353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagaaggaattaaaattatt

SEQ ID NO: 122354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattattaaattattattt

SEQ ID NO: 122355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaattattatttttaaat

SEQ ID NO: 122356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattattatttttaaattta

SEQ ID NO: 122357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatttttaaatttattagg

SEQ ID NO: 122358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttaaatttattaggaat

SEQ ID NO: 122359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaatttattaggaatata

SEQ ID NO: 122360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaatttattaggaatataa

SEQ ID NO: 122361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatttattaggaatataac

SEQ ID NO: 122362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatttattaggaatataact

SEQ ID NO: 122363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaggaatataactttgac

SEQ ID NO: 122364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaggaatataactttgacc

SEQ ID NO: 122365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaatataactttgaccagg

SEQ ID NO: 122366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaccaggaggcttggattc

SEQ ID NO: 122367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaccaggaggcttggattct

SEQ ID NO: 122368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
accaggaggcttggattctg

SEQ ID NO: 122369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggattctgagataaagcaag

SEQ ID NO: 122370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gattctgagataaagcaagt

SEQ ID NO: 122371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgagataaagcaagtgcata

SEQ ID NO: 122372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agataaagcaagtgcatagg

SEQ ID NO: 122373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaacaattcaatgacaaag

SEQ ID NO: 122374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgacaaaggtgcttaact

SEQ ID NO: 122375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacttttatttacagacttc

SEQ ID NO: 122376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acttttatttacagacttct

SEQ ID NO: 122377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatttacagacttcttttt

SEQ ID NO: 122378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttacagacttcttttta

SEQ ID NO: 122379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttacagacttctttttat

SEQ ID NO: 122380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttacagacttctttttatt

SEQ ID NO: 122381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acagacttctttttattatt

SEQ ID NO: 122382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagacttctttttattattc

SEQ ID NO: 122383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttttattattctaactga

SEQ ID NO: 122384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttattattctaactgat

SEQ ID NO: 122385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttattattctaactgatga

SEQ ID NO: 122386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattattctaactgatgaa

SEQ ID NO: 122387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattattctaactgatgaat

SEQ ID NO: 122388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attattctaactgatgaatt

SEQ ID NO: 122389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattctaactgatgaattg

SEQ ID NO: 122390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctaactgatgaattgacc

SEQ ID NO: 122391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taactgatgaattgacctgt

SEQ ID NO: 122392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actgatgaattgacctgttc

SEQ ID NO: 122393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgaattgacctgttcattt

SEQ ID NO: 122394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acctgttcatttttttaaat

SEQ ID NO: 122395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttcatttttttaaatgtcca

SEQ ID NO: 122396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttttttaaatgtccatat

SEQ ID NO: 122397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaaatgtccatatgtca

SEQ ID NO: 122398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaatgtccatatgtcat

SEQ ID NO: 122399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaatgtccatatgtcata

SEQ ID NO: 122400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaatgtccatatgtcatat

SEQ ID NO: 122401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatgtccatatgtcatatt

SEQ ID NO: 122402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgtccatatgtcatattt

SEQ ID NO: 122403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatgaaaatgcaaaattta

SEQ ID NO: 122404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgaaaatgcaaaatttac

SEQ ID NO: 122405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgaaaatgcaaaatttact

SEQ ID NO: 122406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttagtgacctggagtttc

SEQ ID NO: 122407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttagtgacctggagtttcc

SEQ ID NO: 122408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtgacctggagtttccata

SEQ ID NO: 122409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgacctggagtttccataa

SEQ ID NO: 122410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagtttccataaatagtcac

SEQ ID NO: 122411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccataaatagtcaccatttt

SEQ ID NO: 122412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cataaatagtcaccattttt

SEQ ID NO: 122413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcatttgcttgtaactccc

SEQ ID NO: 122414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatttgcttgtaactcccc

SEQ ID NO: 122415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catttgcttgtaactcccca

SEQ ID NO: 122416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttgcttgtaactccccag

SEQ ID NO: 122417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttgtaactccccagtggg

SEQ ID NO: 122418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttgtaactccccagtggga

SEQ ID NO: 122419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaactccccagtgggaaaa

SEQ ID NO: 122420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taactccccagtgggaaaag

SEQ ID NO: 122421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cccagtgggaaaaggtattg

SEQ ID NO: 122422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctaggggacttaacctcca

SEQ ID NO: 122423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggggacttaacctccacaag

SEQ ID NO: 122424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacctccacaaggattgtct

SEQ ID NO: 122425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acctccacaaggattgtcta

SEQ ID NO: 122426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cacaaggattgtctaaaaac

SEQ ID NO: 122427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctaaaaacaagaaatatct

SEQ ID NO: 122428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaacaagaaatatctgtgg

SEQ ID NO: 122429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggtataaacactaacctta

SEQ ID NO: 122430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
accttaaaacttcagttttc

SEQ ID NO: 122431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaacttcagttttcggtaa

SEQ ID NO: 122432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaacttcagttttcggtaac

SEQ ID NO: 122433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagttttcggtaacaaactc

SEQ ID NO: 122434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agttttcggtaacaaactct

SEQ ID NO: 122435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcggtaacaaactcttctga

SEQ ID NO: 122436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cggtaacaaactcttctgaa

SEQ ID NO: 122437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ggtaacaaactcttctgaaa

SEQ ID NO: 122438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttctgaaaacactttaacaa

SEQ ID NO: 122439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgaaaacactttaacaaaa

SEQ ID NO: 122440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaaaacactttaacaaaac

SEQ ID NO: 122441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaacactttaacaaaactg

SEQ ID NO: 122442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taacaaaactgagtgaaaaa

SEQ ID NO: 122443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacaaaactgagtgaaaaat

SEQ ID NO: 122444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaaaactgagtgaaaaata

SEQ ID NO: 122445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtgaaaaataagtgacttt

SEQ ID NO: 122446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tactaaaaattaacagagag

SEQ ID NO: 122447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actaaaaattaacagagaga

SEQ ID NO: 122448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaaaaattaacagagagag

SEQ ID NO: 122449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaattaacagagagaggag

SEQ ID NO: 122450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acagagagaggagatttttg

SEQ ID NO: 122451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgaacttgctttattaaaa

SEQ ID NO: 122452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaacttgctttattaaaat

SEQ ID NO: 122453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaacttgctttattaaaata

SEQ ID NO: 122454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacttgctttattaaaataa

SEQ ID NO: 122455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctttattaaaataaatcta

SEQ ID NO: 122456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttattaaaataaatctaa

SEQ ID NO: 122457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattaaaataaatctaagat

SEQ ID NO: 122458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaaaataaatctaagatt

SEQ ID NO: 122459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaaataaatctaagattc

SEQ ID NO: 122460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaataaatctaagattctaa

SEQ ID NO: 122461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agattctaaatagtagaaat

SEQ ID NO: 122462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaatagtagaaatcattga

SEQ ID NO: 122463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatagtagaaatcattgatc

SEQ ID NO: 122464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atctacttgaccgttgagaa

SEQ ID NO: 122465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttgaccgttgagaaaacaa

SEQ ID NO: 122466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaccgttgagaaaacaagat

SEQ ID NO: 122467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
accgttgagaaaacaagata

SEQ ID NO: 122468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaaaacaagatagcttttc

SEQ ID NO: 122469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctttcttactcattaatt

SEQ ID NO: 122470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttcttactcattaattc

SEQ ID NO: 122471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcttactcattaattca

SEQ ID NO: 122472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcttactcattaattcaa

SEQ ID NO: 122473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttactcattaattcaatt

SEQ ID NO: 122474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttactcattaattcaattt

SEQ ID NO: 122475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttactcattaattcaatttg

SEQ ID NO: 122476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actcattaattcaatttgtt

SEQ ID NO: 122477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcattaattcaatttgttt

SEQ ID NO: 122478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attaattcaatttgtttact

SEQ ID NO: 122479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attcaatttgtttactcaag

SEQ ID NO: 122480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatttgtttactcaagtatt

SEQ ID NO: 122481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttactcaagtattaagca

SEQ ID NO: 122482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttactcaagtattaagcac

SEQ ID NO: 122483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actcaagtattaagcacctt

SEQ ID NO: 122484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcaagtattaagcaccttc

SEQ ID NO: 122485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagtattaagcaccttctct

SEQ ID NO: 122486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcaccttctctgtgcaaag

SEQ ID NO: 122487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctctgtgcaaagccttgtaa

SEQ ID NO: 122488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgtgcaaagccttgtaaa

SEQ ID NO: 122489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtgcaaagccttgtaaaat

SEQ ID NO: 122490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgcaaagccttgtaaaatgg

SEQ ID NO: 122491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaaaatggtctgtgtggat

SEQ ID NO: 122492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaaatggtctgtgtggatt

SEQ ID NO: 122493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtggattacaactacagca

SEQ ID NO: 122494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caactacagcacaatgaatc

SEQ ID NO: 122495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagcacaatgaatccttgtt

SEQ ID NO: 122496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtttgatttaatcatatcta

SEQ ID NO: 122497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgatttaatcatatctag

SEQ ID NO: 122498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatttaatcatatctaggat

SEQ ID NO: 122499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atttaatcatatctaggatt

SEQ ID NO: 122500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatcatatctaggattagaa

SEQ ID NO: 122501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcatatctaggattagaaa

SEQ ID NO: 122502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggattagaaaatgaagggtc

SEQ ID NO: 122503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaaatgaagggtccctaaa

SEQ ID NO: 122504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattcattaactagctaggc

SEQ ID NO: 122505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attaactagctaggcaagga

SEQ ID NO: 122506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actagctaggcaaggatatt

SEQ ID NO: 122507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctaggcaaggatattcttt

SEQ ID NO: 122508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggcaaggatattctttccca

SEQ ID NO: 122509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcccatcaggaattctcc

SEQ ID NO: 122510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcccatcaggaattctccta

SEQ ID NO: 122511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccatcaggaattctcctaa

SEQ ID NO: 122512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccatcaggaattctcctaaa

SEQ ID NO: 122513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctaaattgctagtatatt

SEQ ID NO: 122514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctaaattgctagtatattta

SEQ ID NO: 122515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattgctagtatatttatac

SEQ ID NO: 122516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctagtatatttatacaacaa

SEQ ID NO: 122517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtatatttatacaacaactc

SEQ ID NO: 122518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atacaacaactcaaaagttt

SEQ ID NO: 122519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacaacaactcaaaagtttt

SEQ ID NO: 122520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaagttttaatactggtat

SEQ ID NO: 122521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatactggtataaaagaaa

SEQ ID NO: 122522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatactggtataaaagaaaa

SEQ ID NO: 122523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atactggtataaaagaaaaa

SEQ ID NO: 122524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtataaaagaaaaaacagaa

SEQ ID NO: 122525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgaaatggaaggcacatgt

SEQ ID NO: 122526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaatggaaggcacatgttc

SEQ ID NO: 122527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatggaaggcacatgttca

SEQ ID NO: 122528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agagtaaggcacattcagac

SEQ ID NO: 122529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agactaaaaaccagatctct

SEQ ID NO: 122530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaaccagatctctggggac

SEQ ID NO: 122531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tggggacaatgggtatggga

SEQ ID NO: 122532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gggacaatgggtatgggaaa

SEQ ID NO: 122533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaactctcttagagtctac

SEQ ID NO: 122534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcttagagtctacgaattat

SEQ ID NO: 122535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttagagtctacgaattatat

SEQ ID NO: 122536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agagtctacgaattatatag

SEQ ID NO: 122537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagtctacgaattatatagg

SEQ ID NO: 122538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cgaattatataggaattttt

SEQ ID NO: 122539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tataggaatttttaaaaaat

SEQ ID NO: 122540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaaaatcaccaatgaat

SEQ ID NO: 122541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaaatcaccaatgaatc

SEQ ID NO: 122542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaatcaccaatgaatca

SEQ ID NO: 122543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaatcaccaatgaatcac

SEQ ID NO: 122544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacgtcagagttagaactgt

SEQ ID NO: 122545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaactgtaaatttctaagaa

SEQ ID NO: 122546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaatttctaagaaaatatc

SEQ ID NO: 122547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaagaaaatatcataggga

SEQ ID NO: 122548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taagaaaatatcatagggaa

SEQ ID NO: 122549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaaaatatcatagggaaaa

SEQ ID NO: 122550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cgagacattagatttggcac

SEQ ID NO: 122551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gagacattagatttggcaca

SEQ ID NO: 122552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatttggcacatggacatgg

SEQ ID NO: 122553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcacatggacatggaacca

SEQ ID NO: 122554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcacatggacatggaaccaa

SEQ ID NO: 122555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aattggattttgtcaaaatt

SEQ ID NO: 122556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gattttgtcaaaattgaaac

SEQ ID NO: 122557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtcaaaattgaaactgttg

SEQ ID NO: 122558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcaaaattgaaactgttgt

SEQ ID NO: 122559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaaaattgaaactgttgtg

SEQ ID NO: 122560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaactgttgtgcatcaaaga

SEQ ID NO: 122561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgtgcatcaaagaacacta

SEQ ID NO: 122562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgcatcaaagaacactacta

SEQ ID NO: 122563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctagaaagtgaaaaggcaat

SEQ ID NO: 122564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaagtgaaaaggcaatcca

SEQ ID NO: 122565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaatcatatatctgataag

SEQ ID NO: 122566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ataagggattaacattggca

SEQ ID NO: 122567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acattggcaatatgtaaaaa

SEQ ID NO: 122568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcaatatgtaaaaaattcct

SEQ ID NO: 122569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctactcctcaacaaaaaata

SEQ ID NO: 122570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcctcaacaaaaaataaac

SEQ ID NO: 122571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcaacaaaaaataaacaag

SEQ ID NO: 122572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aacaaaaaataaacaagcag

SEQ ID NO: 122573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatgaacaaaggatttga

SEQ ID NO: 122574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaagacatttttccaaag

SEQ ID NO: 122575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaagacatttttccaaaga

SEQ ID NO: 122576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccaaagaaagtcaatcag

SEQ ID NO: 122577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccaaagaaagtcaatcagt

SEQ ID NO: 122578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaaagaaagtcaatcagta

SEQ ID NO: 122579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaagaaagtcaatcagtac

SEQ ID NO: 122580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aacatcaccgatcatttggg

SEQ ID NO: 122581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggaaatgcaaatcaaaacc

SEQ ID NO: 122582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaaatgcaaatcaaaacca

SEQ ID NO: 122583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacacttggtcggatggtta

SEQ ID NO: 122584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acacttggtcggatggttat

SEQ ID NO: 122585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtcggatggttattgttta

SEQ ID NO: 122586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtcggatggttattgtttaa

SEQ ID NO: 122587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgtttaaaaaaaaaaaagg

SEQ ID NO: 122588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttaaaaaaaaaaaaggaaa

SEQ ID NO: 122589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaaaaaaaaggaaaaga

SEQ ID NO: 122590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaaaaaaaggaaaagaa

SEQ ID NO: 122591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acaagggtgtggagaaattg

SEQ ID NO: 122592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taacccttgtgcattgctga

SEQ ID NO: 122593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgcattgctgataggaata

SEQ ID NO: 122594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgcattgctgataggaatat

SEQ ID NO: 122595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgataggaatataaaatag

SEQ ID NO: 122596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ataggaatataaaatagtgc

SEQ ID NO: 122597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctgtggaaaacactgtggtg

SEQ ID NO: 122598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggaaaacactgtggtggtt

SEQ ID NO: 122599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggtggttcctcaaaaaatt

SEQ ID NO: 122600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcaaaaaattaaacagaaa

SEQ ID NO: 122601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaaaattaaacagaaatat

SEQ ID NO: 122602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacagaaatatcacatgatc

SEQ ID NO: 122603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tactttagggtatacatcct

SEQ ID NO: 122604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctttagggtatacatcctaa

SEQ ID NO: 122605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagggtatacatcctaaaca

SEQ ID NO: 122606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agggtatacatcctaaacaa

SEQ ID NO: 122607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gggtatacatcctaaacaat

SEQ ID NO: 122608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacaattaatagaagggacg

SEQ ID NO: 122609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atagaagggacgcatgtagt

SEQ ID NO: 122610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgtacaccaatgttcata

SEQ ID NO: 122611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tacaccaatgttcatagcag

SEQ ID NO: 122612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atagcagcactaatcacagt

SEQ ID NO: 122613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atcacagtagccaaaaagtg

SEQ ID NO: 122614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaacagatgaacagataaa

SEQ ID NO: 122615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacagccttaaaaatgaata

SEQ ID NO: 122616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaaatgaataaaattctga

SEQ ID NO: 122617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatgaataaaattctgat

SEQ ID NO: 122618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgatatatgctacgacccgg

SEQ ID NO: 122619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atatatgctacgacccggat

SEQ ID NO: 122620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cgacccggatgaacaccttg

SEQ ID NO: 122621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaaacattatgctaagtga

SEQ ID NO: 122622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaacattatgctaagtgaa

SEQ ID NO: 122623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgctaagtgaaataagccag

SEQ ID NO: 122624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtgaaataagccagacatg

SEQ ID NO: 122625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagggttccacttacatgag

SEQ ID NO: 122626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacttacatgaggtacctag

SEQ ID NO: 122627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acatgaggtacctagaatag

SEQ ID NO: 122628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catgaggtacctagaatagt

SEQ ID NO: 122629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaatagtcacattcatagag

SEQ ID NO: 122630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atagagaaagtagaatagtg

SEQ ID NO: 122631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgggtgataggggaagaga

SEQ ID NO: 122632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtgataggggaagagagga

SEQ ID NO: 122633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttaatagttaccgagtttt

SEQ ID NO: 122634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatagttaccgagtttttgt

SEQ ID NO: 122635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atagttaccgagtttttgtt

SEQ ID NO: 122636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccgagtttttgtttggaatg

SEQ ID NO: 122637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtttggaatgatgaaaat

SEQ ID NO: 122638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtttggaatgatgaaaatg

SEQ ID NO: 122639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttggaatgatgaaaatgt

SEQ ID NO: 122640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttggaatgatgaaaatgtt

SEQ ID NO: 122641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaatgatgaaaatgttctg

SEQ ID NO: 122642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaatgatgaaaatgttctga

SEQ ID NO: 122643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaagatggatggtggtgat

SEQ ID NO: 122644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagatggatggtggtgatcg

SEQ ID NO: 122645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatacctctaaactgtacat

SEQ ID NO: 122646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atacctctaaactgtacatt

SEQ ID NO: 122647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taaactgtacatttgaaatg

SEQ ID NO: 122648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aactgtacatttgaaatggt

SEQ ID NO: 122649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tacatttgaaatggttaaaa

SEQ ID NO: 122650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaatggttaaaatggtaaa

SEQ ID NO: 122651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatggttaaaatggtaaat

SEQ ID NO: 122652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatggtaaattttgttata

SEQ ID NO: 122653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttatatatattttaccaa

SEQ ID NO: 122654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttatatatattttaccaaa

SEQ ID NO: 122655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttatatatattttaccaaaa

SEQ ID NO: 122656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatatattttaccaaaatat

SEQ ID NO: 122657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taccaaaatataaattttta

SEQ ID NO: 122658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
accaaaatataaatttttaa

SEQ ID NO: 122659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccaaaatataaatttttaaa

SEQ ID NO: 122660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaattcactagcgtgttt

SEQ ID NO: 122661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaattcactagcgtgtttt

SEQ ID NO: 122662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattcactagcgtgttttg

SEQ ID NO: 122663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattcactagcgtgttttga

SEQ ID NO: 122664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actagcgtgttttgagatcc

SEQ ID NO: 122665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcgtgttttgagatccgtaa

SEQ ID NO: 122666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgagatccgtaaggcagaaa

SEQ ID NO: 122667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagatccgtaaggcagaaag

SEQ ID NO: 122668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agatccgtaaggcagaaaga

SEQ ID NO: 122669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaaccggtcaaccctgaca

SEQ ID NO: 122670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acaacatgcggtgtctcctt

SEQ ID NO: 122671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttggtatctgttttgctag

SEQ ID NO: 122672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtatctgttttgctaggca

SEQ ID NO: 122673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtatctgttttgctaggcag

SEQ ID NO: 122674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttgctaggcagtagtcat

SEQ ID NO: 122675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctaggcagtagtcattta

SEQ ID NO: 122676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctaggcagtagtcatttat

SEQ ID NO: 122677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctaggcagtagtcatttata

SEQ ID NO: 122678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggcagtagtcatttatatct

SEQ ID NO: 122679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatctatgcagtaccacta

SEQ ID NO: 122680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatctatgcagtaccactat

SEQ ID NO: 122681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgcagtaccactatttcatg

SEQ ID NO: 122682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttcatgagaaataatcata

SEQ ID NO: 122683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgagaaataatcatataa

SEQ ID NO: 122684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgagaaataatcatataat

SEQ ID NO: 122685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcgaaatatacaaaatatt

SEQ ID NO: 122686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgtactcccaccattaagt

SEQ ID NO: 122687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tactcccaccattaagtttc

SEQ ID NO: 122688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaccattaagtttccaaaa

SEQ ID NO: 122689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtttccaaaatgcaaacat

SEQ ID NO: 122690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaaaatgcaaacatttaaa

SEQ ID NO: 122691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaaatgcaaacatttaaag

SEQ ID NO: 122692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagttactctcaattgtaa

SEQ ID NO: 122693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagttactctcaattgtaat

SEQ ID NO: 122694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctctcaattgtaatctttgt

SEQ ID NO: 122695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaattgtaatctttgtctt

SEQ ID NO: 122696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aattgtaatctttgtcttat

SEQ ID NO: 122697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatctttgtcttattagcc

SEQ ID NO: 122698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtcttattagccctgcccc

SEQ ID NO: 122699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcttattagccctgccccc

SEQ ID NO: 122700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttattagccctgccccct

SEQ ID NO: 122701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attagccctgccccctgccc

SEQ ID NO: 122702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttagccctgccccctgcccc

SEQ ID NO: 122703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccctgccccctgccccaaa

SEQ ID NO: 122704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccccctgccccaaatagtaa

SEQ ID NO: 122705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccccaaatagtaagaggttc

SEQ ID NO: 122706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caagaatccaatccattaca

SEQ ID NO: 122707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagacaggaagagaatatag

SEQ ID NO: 122708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatataaatacatttacat

SEQ ID NO: 122709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatataaatacatttacata

SEQ ID NO: 122710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatatacataaatagtaaa

SEQ ID NO: 122711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catatacataaatagtaaat

SEQ ID NO: 122712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatctaaatcacaaaaaaa

SEQ ID NO: 122713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catctaaatcacaaaaaaag

SEQ ID NO: 122714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatcacaaaaaaagacaaaa

SEQ ID NO: 122715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttgtatagaaattagaa

SEQ ID NO: 122716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtatagaaattagaaact

SEQ ID NO: 122717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtatagaaattagaaactt

SEQ ID NO: 122718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatagaaattagaaacttc

SEQ ID NO: 122719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatagaaattagaaacttct

SEQ ID NO: 122720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaacttctcaaacattttt

SEQ ID NO: 122721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcaaacatttttttctggt

SEQ ID NO: 122722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaaacatttttttctggtt

SEQ ID NO: 122723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaacatttttttctggtttt

SEQ ID NO: 122724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttctggttttatgttacc

SEQ ID NO: 122725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctggttttatgttaccc

SEQ ID NO: 122726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctggttttatgttaccca

SEQ ID NO: 122727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctggttttatgttacccat

SEQ ID NO: 122728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctggttttatgttacccatg

SEQ ID NO: 122729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggttttatgttacccatgt

SEQ ID NO: 122730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttttatgttacccatgtcc

SEQ ID NO: 122731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgttacccatgtccagaa

SEQ ID NO: 122732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgttacccatgtccagaaa

SEQ ID NO: 122733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgttacccatgtccagaaag

SEQ ID NO: 122734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccatgtccagaaagagatc

SEQ ID NO: 122735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaagagcacactcatccc

SEQ ID NO: 122736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atccctttccaaagttgtac

SEQ ID NO: 122737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccaaagttgtacccatgct

SEQ ID NO: 122738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaaagttgtacccatgctg

SEQ ID NO: 122739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaagttgtacccatgctgg

SEQ ID NO: 122740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tacccatgctggtaatttta

SEQ ID NO: 122741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtaattttagcattggttta

SEQ ID NO: 122742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagcattggtttatcacgca

SEQ ID NO: 122743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcattggtttatcacgcag

SEQ ID NO: 122744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcattggtttatcacgcagc

SEQ ID NO: 122745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtttatcacgcagccctcga

SEQ ID NO: 122746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcacgcagccctcgacgca

SEQ ID NO: 122747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcacgcagccctcgacgcag

SEQ ID NO: 122748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gacgcaggttagtaatccct

SEQ ID NO: 122749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtaatccctacaaaatcaag

SEQ ID NO: 122750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaaatcaagaaaaaccctc

SEQ ID NO: 122751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atcttctgctttcaatcttg

SEQ ID NO: 122752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgctttcaatcttgctgtc

SEQ ID NO: 122753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgctttcaatcttgctgtct

SEQ ID NO: 122754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctttcaatcttgctgtctgt

SEQ ID NO: 122755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaatcttgctgtctgtatt

SEQ ID NO: 122756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatcttgctgtctgtattt

SEQ ID NO: 122757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatcttgctgtctgtatttc

SEQ ID NO: 122758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctgtctgtatttcaaccat

SEQ ID NO: 122759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgtctgtatttcaaccatg

SEQ ID NO: 122760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctgtatttcaaccatgctg

SEQ ID NO: 122761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatttcaaccatgctggttt

SEQ ID NO: 122762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaccatgctggttttcttg

SEQ ID NO: 122763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaccatgctggttttcttgc

SEQ ID NO: 122764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttttcttgcttctccttaa

SEQ ID NO: 122765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttgcttctccttaaatac

SEQ ID NO: 122766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgcttctccttaaataca

SEQ ID NO: 122767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgcttctccttaaatacat

SEQ ID NO: 122768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcttctccttaaatacatca

SEQ ID NO: 122769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttctccttaaatacatcaa

SEQ ID NO: 122770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctccttaaatacatcaaata

SEQ ID NO: 122771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccttaaatacatcaaatat

SEQ ID NO: 122772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttaaatacatcaaatatgc

SEQ ID NO: 122773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaatacatcaaatatgcctt

SEQ ID NO: 122774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatacatcaaatatgcctta

SEQ ID NO: 122775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agggcttttgcaattgctgt

SEQ ID NO: 122776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gggcttttgcaattgctgtt

SEQ ID NO: 122777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgcaattgctgttttttgt

SEQ ID NO: 122778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcaattgctgttttttgtg

SEQ ID NO: 122779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaattgctgttttttgtga

SEQ ID NO: 122780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caattgctgttttttgtgac

SEQ ID NO: 122781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgttttttgtgactagaat

SEQ ID NO: 122782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttttgtgactagaatgat

SEQ ID NO: 122783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgtgactagaatgattct

SEQ ID NO: 122784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtgactagaatgattctt

SEQ ID NO: 122785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgactagaatgattcttc

SEQ ID NO: 122786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgactagaatgattcttca

SEQ ID NO: 122787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgactagaatgattcttcag

SEQ ID NO: 122788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaatgattcttcagttgttt

SEQ ID NO: 122789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcagttgtttagctagctc

SEQ ID NO: 122790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagttgtttagctagctccc

SEQ ID NO: 122791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agttgtttagctagctccct

SEQ ID NO: 122792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttagctagctcccttagtt

SEQ ID NO: 122793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agctagctcccttagttttt

SEQ ID NO: 122794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctagctcccttagtttttc

SEQ ID NO: 122795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctcccttagtttttcattt

SEQ ID NO: 122796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccttagtttttcatttactt

SEQ ID NO: 122797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtttttcatttacttcatg

SEQ ID NO: 122798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtttttcatttacttcatgt

SEQ ID NO: 122799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcatttacttcatgtctct

SEQ ID NO: 122800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatttacttcatgtctcta

SEQ ID NO: 122801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catttacttcatgtctctac

SEQ ID NO: 122802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttacttcatgtctctact

SEQ ID NO: 122803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttcatgtctctactcaaa

SEQ ID NO: 122804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttcatgtctctactcaaat

SEQ ID NO: 122805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catgtctctactcaaatacc

SEQ ID NO: 122806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtctctactcaaataccc

SEQ ID NO: 122807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tactcaaataccctgtataa

SEQ ID NO: 122808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcaaataccctgtataaaa

SEQ ID NO: 122809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaataccctgtataaaattt

SEQ ID NO: 122810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tataaaatttttcagaccac

SEQ ID NO: 122811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcagaccactttaaataat

SEQ ID NO: 122812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagaccactttaaataata

SEQ ID NO: 122813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagaccactttaaataatac

SEQ ID NO: 122814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaccactttaaataatacc

SEQ ID NO: 122815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaataatacctccttctct

SEQ ID NO: 122816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaataatacctccttctctc

SEQ ID NO: 122817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataatacctccttctctca

SEQ ID NO: 122818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttctctcaattctctgtcc

SEQ ID NO: 122819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctctcaattctctgtcctgt

SEQ ID NO: 122820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctcaattctctgtcctgtt

SEQ ID NO: 122821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaattctctgtcctgtttt

SEQ ID NO: 122822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aattctctgtcctgttttat

SEQ ID NO: 122823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgtcctgttttattgttt

SEQ ID NO: 122824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtcctgttttattgttttt

SEQ ID NO: 122825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcctgttttattgtttttca

SEQ ID NO: 122826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttattgtttttcacagca

SEQ ID NO: 122827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattgtttttcacagcatat

SEQ ID NO: 122828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgtttttcacagcatatc

SEQ ID NO: 122829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgtttttcacagcatatct

SEQ ID NO: 122830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttttcacagcatatcttat

SEQ ID NO: 122831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcacagcatatcttatggt

SEQ ID NO: 122832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcacagcatatcttatggta

SEQ ID NO: 122833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacagcatatcttatggtac

SEQ ID NO: 122834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acagcatatcttatggtaca

SEQ ID NO: 122835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atggtacaatgatggatagt

SEQ ID NO: 122836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggtacaatgatggatagtg

SEQ ID NO: 122837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctcttcattatctcttaa

SEQ ID NO: 122838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctcttcattatctcttaaa

SEQ ID NO: 122839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcattatctcttaaaatcg

SEQ ID NO: 122840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattatctcttaaaatcggc

SEQ ID NO: 122841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attatctcttaaaatcggcg

SEQ ID NO: 122842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctcttaaaatcggcgtcac

SEQ ID NO: 122843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaaaatcggcgtcacatct

SEQ ID NO: 122844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaatcggcgtcacatctcc

SEQ ID NO: 122845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatcggcgtcacatctcca

SEQ ID NO: 122846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catgtgttgttcattgctat

SEQ ID NO: 122847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttcattgctatatctgatgt

SEQ ID NO: 122848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attgctatatctgatgtcta

SEQ ID NO: 122849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctatatctgatgtctacaat

SEQ ID NO: 122850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatctgatgtctacaataaa

SEQ ID NO: 122851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgtctacaataaaacttta

SEQ ID NO: 122852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caataaaactttatgaagaa

SEQ ID NO: 122853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatgaagaaggaagagaggg

SEQ ID NO: 122854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgaagaaggaagagaggga

SEQ ID NO: 122855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgaagaaggaagagagggaa

SEQ ID NO: 122856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttttaaattccaggaagag

SEQ ID NO: 122857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaattccaggaagagtat

SEQ ID NO: 122858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaattccaggaagagtata

SEQ ID NO: 122859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattccaggaagagtataa

SEQ ID NO: 122860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattccaggaagagtataaa

SEQ ID NO: 122861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caggaagagtataaatgctg

SEQ ID NO: 122862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaggagtgaggttgtgagt

SEQ ID NO: 122863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgagttcttggaactggcct

SEQ ID NO: 122864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttggaactggcctggaggga

SEQ ID NO: 122865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaactggcctggagggact

SEQ ID NO: 122866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaactggcctggagggactc

SEQ ID NO: 122867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcctggagggactcagcagc

SEQ ID NO: 122868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagggactcagcagccgctt

SEQ ID NO: 122869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcagccgcttaccactgcc

SEQ ID NO: 122870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
accactgcccttgggatctc

SEQ ID NO: 122871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccactgcccttgggatctct

SEQ ID NO: 122872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cccttgggatctctgccagg

SEQ ID NO: 122873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gggatctctgccaggtcttc

SEQ ID NO: 122874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggatctctgccaggtcttcc

SEQ ID NO: 122875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgccaggtcttccctcccta

SEQ ID NO: 122876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccaggtcttccctccctaca

SEQ ID NO: 122877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctccctacaaacctcaat

SEQ ID NO: 122878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctccctacaaacctcaatg

SEQ ID NO: 122879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctacaaacctcaatggcac

SEQ ID NO: 122880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaacctcaatggcaccaat

SEQ ID NO: 122881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatggcaccaataccaactt

SEQ ID NO: 122882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggatgccaactcctgaccta

SEQ ID NO: 122883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gatgccaactcctgacctac

SEQ ID NO: 122884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgacctacacattttggag

SEQ ID NO: 122885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acctacacattttggaggcc

SEQ ID NO: 122886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacattttggaggccaacta

SEQ ID NO: 122887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggaggccaactagaccgga

SEQ ID NO: 122888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaggccaactagaccggat

SEQ ID NO: 122889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaggccaactagaccggatc

SEQ ID NO: 122890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaccggatctaatgattaat

SEQ ID NO: 122891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgattaatccctaggctaa

SEQ ID NO: 122892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atccctaggctaagataaat

SEQ ID NO: 122893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggctaagataaatcagttgg

SEQ ID NO: 122894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agataaatcagttggaaatt

SEQ ID NO: 122895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaatttcagctttaacttt

SEQ ID NO: 122896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagctttaactttgtttttt

SEQ ID NO: 122897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agctttaactttgttttttc

SEQ ID NO: 122898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taactttgttttttcttatc

SEQ ID NO: 122899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactttgttttttcttatct

SEQ ID NO: 122900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actttgttttttcttatctg

SEQ ID NO: 122901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgttttttcttatctgccag

SEQ ID NO: 122902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttttttcttatctgccagt

SEQ ID NO: 122903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttttcttatctgccagtc

SEQ ID NO: 122904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcttatctgccagtctac

SEQ ID NO: 122905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttatctgccagtctacc

SEQ ID NO: 122906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttatctgccagtctacct

SEQ ID NO: 122907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttatctgccagtctacctg

SEQ ID NO: 122908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatctgccagtctacctgt

SEQ ID NO: 122909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atctgccagtctacctgtta

SEQ ID NO: 122910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgccagtctacctgttaa

SEQ ID NO: 122911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccagtctacctgttaagcat

SEQ ID NO: 122912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctgttaagcatatctgtca

SEQ ID NO: 122913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttaagcatatctgtcactgt

SEQ ID NO: 122914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcatatctgtcactgtcaa

SEQ ID NO: 122915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcactgtcaaaagttttcgt

SEQ ID NO: 122916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcaaaagttttcgtgtccct

SEQ ID NO: 122917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcgtgtccctttacttattt

SEQ ID NO: 122918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgtgtccctttacttatttc

SEQ ID NO: 122919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gtgtccctttacttatttca

SEQ ID NO: 122920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacttatttcacttagcatg

SEQ ID NO: 122921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttatttcacttagcatgt

SEQ ID NO: 122922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttatttcacttagcatgtc

SEQ ID NO: 122923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttcacttagcatgtctct

SEQ ID NO: 122924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcacttagcatgtctctt

SEQ ID NO: 122925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacttagcatgtctcttcta

SEQ ID NO: 122926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acttagcatgtctcttctag

SEQ ID NO: 122927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agcatgtctcttctaggtcc

SEQ ID NO: 122928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcatgtctcttctaggtcca

SEQ ID NO: 122929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttctaggtccatgcatgctg

SEQ ID NO: 122930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaggtccatgcatgctgtc

SEQ ID NO: 122931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taggtccatgcatgctgtca

SEQ ID NO: 122932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtccatgcatgctgtcaca

SEQ ID NO: 122933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcacaaatagtaagatttcc

SEQ ID NO: 122934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttctttttttaaggctag

SEQ ID NO: 122935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttctttttttaaggctaga

SEQ ID NO: 122936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttttttaaggctagataa

SEQ ID NO: 122937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttttaaggctagataat

SEQ ID NO: 122938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttaaggctagataatat

SEQ ID NO: 122939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaaggctagataatatt

SEQ ID NO: 122940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaggctagataatattc

SEQ ID NO: 122941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaggctagataatattct

SEQ ID NO: 122942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaggctagataatattcta

SEQ ID NO: 122943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaggctagataatattctat

SEQ ID NO: 122944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggctagataatattctatt

SEQ ID NO: 122945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gataatattctattttatat

SEQ ID NO: 122946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattttatatacagaccaca

SEQ ID NO: 122947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttatatacagaccacatt

SEQ ID NO: 122948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatatacagaccacattttc

SEQ ID NO: 122949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatacagaccacattttct

SEQ ID NO: 122950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatacagaccacattttctt

SEQ ID NO: 122951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttactcttttatctgtt

SEQ ID NO: 122952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttactcttttatctgttg

SEQ ID NO: 122953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttactcttttatctgttga

SEQ ID NO: 122954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tactcttttatctgttgatg

SEQ ID NO: 122955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actcttttatctgttgatga

SEQ ID NO: 122956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcttttatctgttgatgat

SEQ ID NO: 122957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttatctgttgatgatcat

SEQ ID NO: 122958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatctgttgatgatcattt

SEQ ID NO: 122959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatctgttgatgatcatttg

SEQ ID NO: 122960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctgttgatgatcatttgg

SEQ ID NO: 122961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgttgatgatcatttggg

SEQ ID NO: 122962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgatgatcatttgggttgt

SEQ ID NO: 122963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgatcatttgggttgtttt

SEQ ID NO: 122964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggttgttttcatatttttg

SEQ ID NO: 122965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggttgttttcatatttttgc

SEQ ID NO: 122966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttcatatttttgctattg

SEQ ID NO: 122967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatatttttgctattgtga

SEQ ID NO: 122968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catatttttgctattgtgaa

SEQ ID NO: 122969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatttttgctattgtgaat

SEQ ID NO: 122970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgctattgtgaataatgct

SEQ ID NO: 122971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctattgtgaataatgctg

SEQ ID NO: 122972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctattgtgaataatgctgc

SEQ ID NO: 122973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctattgtgaataatgctgca

SEQ ID NO: 122974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgtgaataatgctgcagta

SEQ ID NO: 122975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaataatgctgcagtaaac

SEQ ID NO: 122976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagtaaacacagaagtgcat

SEQ ID NO: 122977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttgagattctgatttcaat

SEQ ID NO: 122978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgagattctgatttcaattg

SEQ ID NO: 122979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagattctgatttcaattgc

SEQ ID NO: 122980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agattctgatttcaattgct

SEQ ID NO: 122981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgatttcaattgctggatca

SEQ ID NO: 122982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atttcaattgctggatcata

SEQ ID NO: 122983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caattgctggatcatatggt

SEQ ID NO: 122984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aattgctggatcatatggta

SEQ ID NO: 122985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctggatcatatggtagttct

SEQ ID NO: 122986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatcatatggtagttctatt

SEQ ID NO: 122987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatttttaattttttgagga

SEQ ID NO: 122988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttttaattttttgaggaac

SEQ ID NO: 122989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaattttttgaggaacttc

SEQ ID NO: 122990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattttttgaggaacttcc

SEQ ID NO: 122991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattttttgaggaacttcca

SEQ ID NO: 122992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttttgaggaacttccat

SEQ ID NO: 122993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgaggaacttccatatta

SEQ ID NO: 122994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgaggaacttccatattat

SEQ ID NO: 122995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaggaacttccatattatt

SEQ ID NO: 122996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaggaacttccatattattt

SEQ ID NO: 122997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggaacttccatattatttt

SEQ ID NO: 122998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccatattattttccatagca

SEQ ID NO: 122999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catattattttccatagcag

SEQ ID NO: 123000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttccatagcagctacact

SEQ ID NO: 123001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccatagcagctacactatt

SEQ ID NO: 123002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccatagcagctacactatta

SEQ ID NO: 123003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catagcagctacactattat

SEQ ID NO: 123004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cactattatacattcccacc

SEQ ID NO: 123005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttatacattcccaccaacag

SEQ ID NO: 123006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacattcccaccaacagtgg

SEQ ID NO: 123007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaccaacagtggacaatgc

SEQ ID NO: 123008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcattttcttcacattctca

SEQ ID NO: 123009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattttcttcacattctcaa

SEQ ID NO: 123010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attttcttcacattctcaac

SEQ ID NO: 123011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttcacattctcaacaaca

SEQ ID NO: 123012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcacattctcaacaacac

SEQ ID NO: 123013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcacattctcaacaacacc

SEQ ID NO: 123014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacattctcaacaacacctt

SEQ ID NO: 123015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acattctcaacaacaccttt

SEQ ID NO: 123016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaacaacacctttcacttt

SEQ ID NO: 123017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aacaacacctttcacttttt

SEQ ID NO: 123018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcacttttttataacagcca

SEQ ID NO: 123019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacttttttataacagccat

SEQ ID NO: 123020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acttttttataacagccatc

SEQ ID NO: 123021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttataacagccatcttaa

SEQ ID NO: 123022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttataacagccatcttaac

SEQ ID NO: 123023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttataacagccatcttaaca

SEQ ID NO: 123024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tataacagccatcttaacag

SEQ ID NO: 123025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataacagccatcttaacagg

SEQ ID NO: 123026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taacagccatcttaacaggt

SEQ ID NO: 123027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacaggtgtgagatgattat

SEQ ID NO: 123028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaggtgtgagatgattatc

SEQ ID NO: 123029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctcattgcagtgctgataa

SEQ ID NO: 123030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attgcagtgctgataaaacc

SEQ ID NO: 123031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagtgctgataaaaccttaa

SEQ ID NO: 123032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ataaaaccttaaccacttag

SEQ ID NO: 123033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaccacttagtctagaggat

SEQ ID NO: 123034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
accacttagtctagaggata

SEQ ID NO: 123035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtctagaggataagctacc

SEQ ID NO: 123036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtctagaggataagctacca

SEQ ID NO: 123037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaggataagctaccaatcca

SEQ ID NO: 123038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccaatccacaaatcactaaa

SEQ ID NO: 123039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatagattgagacgtatca

SEQ ID NO: 123040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agacgtatcatagaactcaa

SEQ ID NO: 123041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagggccaaatttcccatgg

SEQ ID NO: 123042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccatggtttttatatccca

SEQ ID NO: 123043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccatggtttttatatcccaa

SEQ ID NO: 123044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatatcccaaagtacagta

SEQ ID NO: 123045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatatcccaaagtacagtat

SEQ ID NO: 123046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatcccaaagtacagtatc

SEQ ID NO: 123047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatcccaaagtacagtatct

SEQ ID NO: 123048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtggataatagatatttaa

SEQ ID NO: 123049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaaattgcatgcaaaaa

SEQ ID NO: 123050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaattgcatgcaaaaat

SEQ ID NO: 123051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catgcaaaaattattataaa

SEQ ID NO: 123052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttataaacataatgtaaaat

SEQ ID NO: 123053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaacataatgtaaaataaa

SEQ ID NO: 123054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttttccaaaactgttttaa

SEQ ID NO: 123055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccaaaactgttttaaaacc

SEQ ID NO: 123056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaaaactgttttaaaaccc

SEQ ID NO: 123057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaaactgttttaaaaccct

SEQ ID NO: 123058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttaaaacccttaaaagtc

SEQ ID NO: 123059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaacccttaaaagtcaac

SEQ ID NO: 123060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaacccttaaaagtcaact

SEQ ID NO: 123061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaacccttaaaagtcaactt

SEQ ID NO: 123062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaagtcaacttcttgcatt

SEQ ID NO: 123063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagtcaacttcttgcatta

SEQ ID NO: 123064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttgcattactgatgttaga

SEQ ID NO: 123065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgcattactgatgttagac

SEQ ID NO: 123066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcattactgatgttagacaa

SEQ ID NO: 123067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattactgatgttagacaat

SEQ ID NO: 123068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgatgttagacaatttaac

SEQ ID NO: 123069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgttagacaatttaactga

SEQ ID NO: 123070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gacaatttaactgacttaga

SEQ ID NO: 123071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactgacttagataattgag

SEQ ID NO: 123072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actgacttagataattgagt

SEQ ID NO: 123073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acttagataattgagtcttc

SEQ ID NO: 123074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agataattgagtcttcatga

SEQ ID NO: 123075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gataattgagtcttcatgac

SEQ ID NO: 123076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtcttcatgacaataagta

SEQ ID NO: 123077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catgacaataagtactgtga

SEQ ID NO: 123078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgacaataagtactgtgat

SEQ ID NO: 123079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgatttaggtttcatttgtg

SEQ ID NO: 123080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggtttcatttgtgtgtatc

SEQ ID NO: 123081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtttcatttgtgtgtatca

SEQ ID NO: 123082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catttgtgtgtatcaatttg

SEQ ID NO: 123083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttgtgtgtatcaatttgt

SEQ ID NO: 123084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgtgtatcaatttgtgatg

SEQ ID NO: 123085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtgtatcaatttgtgatgc

SEQ ID NO: 123086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgatgctctaaatatttgt

SEQ ID NO: 123087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgatgctctaaatatttgta

SEQ ID NO: 123088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taaatatttgtactcctcca

SEQ ID NO: 123089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatatttgtactcctccaat

SEQ ID NO: 123090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtactcctccaatatagaat

SEQ ID NO: 123091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tactcctccaatatagaata

SEQ ID NO: 123092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctccaatatagaatatctaa

SEQ ID NO: 123093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caatatagaatatctaaatt

SEQ ID NO: 123094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatttttattttccaagata

SEQ ID NO: 123095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattttccaagatatataa

SEQ ID NO: 123096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttccaagatatataaa

SEQ ID NO: 123097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttccaagatatataaat

SEQ ID NO: 123098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttccaagatatataaata

SEQ ID NO: 123099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccaagatatataaatactt

SEQ ID NO: 123100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaagatatataaatacttc

SEQ ID NO: 123101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caagatatataaatacttcc

SEQ ID NO: 123102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaatgaacaccatcatctt

SEQ ID NO: 123103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caatgaacaccatcatctta

SEQ ID NO: 123104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atcctgcacaagatcacttt

SEQ ID NO: 123105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcctgcacaagatcactttg

SEQ ID NO: 123106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cacaagatcactttgctttt

SEQ ID NO: 123107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcttttcatacttctccat

SEQ ID NO: 123108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttttcatacttctccatc

SEQ ID NO: 123109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttttcatacttctccatct

SEQ ID NO: 123110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcatacttctccatctgct

SEQ ID NO: 123111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatacttctccatctgcta

SEQ ID NO: 123112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catacttctccatctgctag

SEQ ID NO: 123113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atacttctccatctgctagc

SEQ ID NO: 123114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctccatctgctagctccagg

SEQ ID NO: 123115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccatctgctagctccagga

SEQ ID NO: 123116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catctgctagctccaggatc

SEQ ID NO: 123117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctagctccaggatctcaacg

SEQ ID NO: 123118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctccaggatctcaacgtgt

SEQ ID NO: 123119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caggatctcaacgtgtgtaa

SEQ ID NO: 123120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aacgtgtgtaacttcattcc

SEQ ID NO: 123121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattccctgtttcttctcca

SEQ ID NO: 123122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attccctgtttcttctccat

SEQ ID NO: 123123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctgtttcttctccatttca

SEQ ID NO: 123124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttcttctccatttcagaat

SEQ ID NO: 123125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttctccatttcagaataaa

SEQ ID NO: 123126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctccatttcagaataaac

SEQ ID NO: 123127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctccatttcagaataaactt

SEQ ID NO: 123128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccatttcagaataaacttc

SEQ ID NO: 123129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catttcagaataaacttcat

SEQ ID NO: 123130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagaataaacttcatcctag

SEQ ID NO: 123131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaataaacttcatcctaga

SEQ ID NO: 123132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catcctagacatttttttaa

SEQ ID NO: 123133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcctagacatttttttaat

SEQ ID NO: 123134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gacatttttttaattttttt

SEQ ID NO: 123135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaattttttttcttgag

SEQ ID NO: 123136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaattttttttcttgaga

SEQ ID NO: 123137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaattttttttcttgagac

SEQ ID NO: 123138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattttttttcttgagact

SEQ ID NO: 123139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattttttttcttgagactg

SEQ ID NO: 123140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttttttcttgagactga

SEQ ID NO: 123141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttcttgagactgagtct

SEQ ID NO: 123142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttcttgagactgagtctc

SEQ ID NO: 123143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcttgagactgagtctcg

SEQ ID NO: 123144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttgagactgagtctcgc

SEQ ID NO: 123145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttgagactgagtctcgct

SEQ ID NO: 123146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgagactgagtctcgctc

SEQ ID NO: 123147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgagactgagtctcgctct

SEQ ID NO: 123148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagactgagtctcgctctgt

SEQ ID NO: 123149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agactgagtctcgctctgtt

SEQ ID NO: 123150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtctcgctctgttgcccag

SEQ ID NO: 123151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gctctgttgcccaggcagga

SEQ ID NO: 123152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgttgcccaggcaggagtgc

SEQ ID NO: 123153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgcccaggcaggagtgcag

SEQ ID NO: 123154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccaggcaggagtgcagtgg

SEQ ID NO: 123155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gatctcagctcactgcaacc

SEQ ID NO: 123156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agctcactgcaacctccatc

SEQ ID NO: 123157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actgcaacctccatctccca

SEQ ID NO: 123158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caacctccatctcccaggtt

SEQ ID NO: 123159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catctcccaggttcaggcaa

SEQ ID NO: 123160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaggttcaggcaattctcc

SEQ ID NO: 123161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggcaattctcctgcctcag

SEQ ID NO: 123162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctgcctcagcctcccgag

SEQ ID NO: 123163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgcctcagcctcccgagaa

SEQ ID NO: 123164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctcagcctcccgagaagct

SEQ ID NO: 123165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcctcccgagaagctggga

SEQ ID NO: 123166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccgagaagctgggactacag

SEQ ID NO: 123167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggactacaggtgctggccac

SEQ ID NO: 123168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caggtgctggccaccatgcc

SEQ ID NO: 123169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gccaccatgcctggatagtt

SEQ ID NO: 123170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatagtttttgtattttttt

SEQ ID NO: 123171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtattttttttagtagag

SEQ ID NO: 123172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtattttttttagtagaga

SEQ ID NO: 123173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtattttttttagtagagat

SEQ ID NO: 123174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattttttttagtagagatg

SEQ ID NO: 123175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttagtagagatggggtt

SEQ ID NO: 123176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttagtagagatggggttt

SEQ ID NO: 123177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttagtagagatggggtttc

SEQ ID NO: 123178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagtagagatggggtttca

SEQ ID NO: 123179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagtagagatggggtttcac

SEQ ID NO: 123180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtagagatggggtttcact

SEQ ID NO: 123181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtagagatggggtttcacta

SEQ ID NO: 123182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cactatgttgaccaggctgg

SEQ ID NO: 123183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actatgttgaccaggctggt

SEQ ID NO: 123184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgttgaccaggctggtctcc

SEQ ID NO: 123185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
accaggctggtctccaactc

SEQ ID NO: 123186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtctccaactcctgacctca

SEQ ID NO: 123187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caactcctgacctcaagtga

SEQ ID NO: 123188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgacctcaagtgatcagcc

SEQ ID NO: 123189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acctcaagtgatcagcctgc

SEQ ID NO: 123190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagtgatcagcctgcctcag

SEQ ID NO: 123191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctcagccttccaaagtgct

SEQ ID NO: 123192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agccttccaaagtgctggat

SEQ ID NO: 123193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaaagtgctggattacggg

SEQ ID NO: 123194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaagtgctggattacgggc

SEQ ID NO: 123195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gattacgggcgtaagccacc

SEQ ID NO: 123196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cgggcgtaagccaccgcgcc

SEQ ID NO: 123197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcccaccctagacattttat

SEQ ID NO: 123198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gacattttatacatatttcc

SEQ ID NO: 123199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatacatatttcccttttaa

SEQ ID NO: 123200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atacatatttcccttttaat

SEQ ID NO: 123201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacatatttcccttttaatt

SEQ ID NO: 123202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccttttaattacaccattc

SEQ ID NO: 123203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttttaattacaccattcc

SEQ ID NO: 123204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaattacaccattcctctt

SEQ ID NO: 123205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattacaccattcctcttt

SEQ ID NO: 123206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattacaccattcctctttt

SEQ ID NO: 123207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attacaccattcctcttttt

SEQ ID NO: 123208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caccattcctcttttttcaa

SEQ ID NO: 123209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcttttttcaaatcttttc

SEQ ID NO: 123210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttttcaaatcttttctac

SEQ ID NO: 123211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttcaaatcttttctacct

SEQ ID NO: 123212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcaaatcttttctacctt

SEQ ID NO: 123213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcaaatcttttctaccttg

SEQ ID NO: 123214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaatcttttctaccttgg

SEQ ID NO: 123215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaatcttttctaccttggg

SEQ ID NO: 123216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaatcttttctaccttgggg

SEQ ID NO: 123217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctaccttggggaaggcct

SEQ ID NO: 123218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctaccttggggaaggcctt

SEQ ID NO: 123219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaccttggggaaggccttt

SEQ ID NO: 123220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taccttggggaaggcctttt

SEQ ID NO: 123221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccttggggaaggcctttttc

SEQ ID NO: 123222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggggaaggcctttttcccat

SEQ ID NO: 123223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggaaggcctttttcccatt

SEQ ID NO: 123224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttcccatttcagtttttta

SEQ ID NO: 123225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcccatttcagttttttaa

SEQ ID NO: 123226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcccatttcagttttttaat

SEQ ID NO: 123227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccatttcagttttttaatg

SEQ ID NO: 123228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccatttcagttttttaatgt

SEQ ID NO: 123229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagttttttaatgttaaaac

SEQ ID NO: 123230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agttttttaatgttaaaaca

SEQ ID NO: 123231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaatgttaaaacaaaata

SEQ ID NO: 123232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaatgttaaaacaaaatat

SEQ ID NO: 123233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatgttaaaacaaaatatg

SEQ ID NO: 123234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatgttaaaacaaaatatgc

SEQ ID NO: 123235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgttaaaacaaaatatgcg

SEQ ID NO: 123236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaacaaaatatgcgaatcat

SEQ ID NO: 123237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctagaccaggaaagtgaagt

SEQ ID NO: 123238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaccaggaaagtgaagtcat

SEQ ID NO: 123239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacctataaaacaacttcaa

SEQ ID NO: 123240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaaacaacttcaaaaacac

SEQ ID NO: 123241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaaaacactttaaatgcat

SEQ ID NO: 123242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaacactttaaatgcata

SEQ ID NO: 123243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaatgcataggtactcttt

SEQ ID NO: 123244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatgcataggtactctttt

SEQ ID NO: 123245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgcataggtactcttttc

SEQ ID NO: 123246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttcataatgtcttcaaac

SEQ ID NO: 123247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcataatgtcttcaaactt

SEQ ID NO: 123248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcataatgtcttcaaacttc

SEQ ID NO: 123249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cataatgtcttcaaacttcc

SEQ ID NO: 123250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataatgtcttcaaacttcca

SEQ ID NO: 123251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaacttccaccaaaatctc

SEQ ID NO: 123252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaacttccaccaaaatctct

SEQ ID NO: 123253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaccaaaatctctattttg

SEQ ID NO: 123254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caccaaaatctctattttga

SEQ ID NO: 123255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tattttgacttaacacaata

SEQ ID NO: 123256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttgacttaacacaatata

SEQ ID NO: 123257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgacttaacacaatataccc

SEQ ID NO: 123258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacttaacacaatatacccc

SEQ ID NO: 123259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acttaacacaatatacccct

SEQ ID NO: 123260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacacaatatacccctcagg

SEQ ID NO: 123261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acacaatatacccctcagga

SEQ ID NO: 123262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggaattggtgtccaagaag

SEQ ID NO: 123263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgtccaagaagaaaattga

SEQ ID NO: 123264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaacagtcatccatctttct

SEQ ID NO: 123265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttttttgttgttttcta

SEQ ID NO: 123266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttttttgttgttttctat

SEQ ID NO: 123267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttttgttgttttctatt

SEQ ID NO: 123268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttgttgttttctattag

SEQ ID NO: 123269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttgttgttttctattagc

SEQ ID NO: 123270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgttgttttctattagct

SEQ ID NO: 123271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgttgttttctattagctg

SEQ ID NO: 123272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttgttttctattagctgt

SEQ ID NO: 123273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttgttttctattagctgta

SEQ ID NO: 123274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgttttctattagctgtaa

SEQ ID NO: 123275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttctattagctgtaatta

SEQ ID NO: 123276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctattagctgtaattacat

SEQ ID NO: 123277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctattagctgtaattacatg

SEQ ID NO: 123278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattagctgtaattacatga

SEQ ID NO: 123279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttagctgtaattacatgatt

SEQ ID NO: 123280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctgtaattacatgatttag

SEQ ID NO: 123281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taattacatgatttagtatg

SEQ ID NO: 123282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catgatttagtatgtttgat

SEQ ID NO: 123283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtatgtttgattgcaaatg

SEQ ID NO: 123284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtatgtttgattgcaaatgt

SEQ ID NO: 123285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gattgcaaatgtaattttat

SEQ ID NO: 123286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attgcaaatgtaattttatt

SEQ ID NO: 123287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaatgtaattttattttag

SEQ ID NO: 123288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttagctccattaaggg

SEQ ID NO: 123289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttagctccattaagggt

SEQ ID NO: 123290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttagctccattaagggtt

SEQ ID NO: 123291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagctccattaagggttaaa

SEQ ID NO: 123292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agctccattaagggttaaac

SEQ ID NO: 123293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctccattaagggttaaaca

SEQ ID NO: 123294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cattaagggttaaacatatt

SEQ ID NO: 123295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agggttaaacatatttgata

SEQ ID NO: 123296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacatatttgatagaatgct

SEQ ID NO: 123297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatagaatgcttggtagcgt

SEQ ID NO: 123298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atagaatgcttggtagcgta

SEQ ID NO: 123299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtagcgtaaccaccaggta

SEQ ID NO: 123300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtagcgtaaccaccaggtat

SEQ ID NO: 123301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtggggtatgtgcaaacgt

SEQ ID NO: 123302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttggaatatataagatttct

SEQ ID NO: 123303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaatatataagatttcttt

SEQ ID NO: 123304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaatatataagatttctttc

SEQ ID NO: 123305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcctataaaagaaatgt

SEQ ID NO: 123306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcctataaaagaaatgtg

SEQ ID NO: 123307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcctataaaagaaatgtgta

SEQ ID NO: 123308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctataaaagaaatgtgtat

SEQ ID NO: 123309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctataaaagaaatgtgtatg

SEQ ID NO: 123310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaaagaaatgtgtatgtta

SEQ ID NO: 123311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcaagtttagtaaccattg

SEQ ID NO: 123312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagtttagtaaccattgtga

SEQ ID NO: 123313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtaaccattgtgagtcttt

SEQ ID NO: 123314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtaaccattgtgagtctttg

SEQ ID NO: 123315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgagtctttggaaaggttag

SEQ ID NO: 123316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggaaaggttaggtaatttc

SEQ ID NO: 123317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaaaggttaggtaatttct

SEQ ID NO: 123318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaaggttaggtaatttctg

SEQ ID NO: 123319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtaatttctgagccttagt

SEQ ID NO: 123320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgagccttagtgttctcac

SEQ ID NO: 123321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgagccttagtgttctcacc

SEQ ID NO: 123322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agccttagtgttctcacctc

SEQ ID NO: 123323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtgttctcacctcaaatgg

SEQ ID NO: 123324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgttctcacctcaaatggt

SEQ ID NO: 123325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcacctcaaatggtggtcat

SEQ ID NO: 123326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acctcaaatggtggtcatga

SEQ ID NO: 123327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaatggtggtcatgaggatt

SEQ ID NO: 123328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaacggagcatatgaaaatc

SEQ ID NO: 123329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacggagcatatgaaaatcc

SEQ ID NO: 123330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacaaactgctcagttagca

SEQ ID NO: 123331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaaactgctcagttagcat

SEQ ID NO: 123332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctcagttagcattaaggaga

SEQ ID NO: 123333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agttagcattaaggagacgt

SEQ ID NO: 123334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcattaaggagacgtccata

SEQ ID NO: 123335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggagacgtccatacataag

SEQ ID NO: 123336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttacattaatattatcagta

SEQ ID NO: 123337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cattaatattatcagtaatg

SEQ ID NO: 123338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atattatcagtaatgttagc

SEQ ID NO: 123339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcagtaatgttagcaagatg

SEQ ID NO: 123340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaagatgtaaacttttccg

SEQ ID NO: 123341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttccgtatgtatttttcctt

SEQ ID NO: 123342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccgtatgtatttttccttg

SEQ ID NO: 123343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccgtatgtatttttccttgt

SEQ ID NO: 123344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cgtatgtatttttccttgta

SEQ ID NO: 123345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccttgtaacagcataatt

SEQ ID NO: 123346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccttgtaacagcataattg

SEQ ID NO: 123347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttgtaacagcataattgc

SEQ ID NO: 123348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttgtaacagcataattgct

SEQ ID NO: 123349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaacagcataattgctggc

SEQ ID NO: 123350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taacagcataattgctggcc

SEQ ID NO: 123351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctggccttgcacagtggctt

SEQ ID NO: 123352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gccttgcacagtggcttaca

SEQ ID NO: 123353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcacagtggcttacacctgt

SEQ ID NO: 123354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cacagtggcttacacctgta

SEQ ID NO: 123355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acacctgtaatcccaacact

SEQ ID NO: 123356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacctgtaatcccaacactt

SEQ ID NO: 123357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taatcccaacactttagaag

SEQ ID NO: 123358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagaaggccgaggtgggcag

SEQ ID NO: 123359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaaggccgaggtgggcaga

SEQ ID NO: 123360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaggccgaggtgggcagat

SEQ ID NO: 123361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggtcaggaattcgagacta

SEQ ID NO: 123362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gagactagtctggccaacat

SEQ ID NO: 123363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtctggccaacatggtgaaa

SEQ ID NO: 123364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gccaacatggtgaaacccca

SEQ ID NO: 123365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tactaaaactgcaaaattag

SEQ ID NO: 123366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaaaactgcaaaattagcc

SEQ ID NO: 123367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaactgcaaaattagccggg

SEQ ID NO: 123368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caaaattagccgggcatggt

SEQ ID NO: 123369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccgggcatggtggtacatg

SEQ ID NO: 123370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taatcccagctacttgggag

SEQ ID NO: 123371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttgggaggctgaggcagga

SEQ ID NO: 123372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gggaggctgaggcaggagaa

SEQ ID NO: 123373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaggctgaggcaggagaat

SEQ ID NO: 123374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggcaggagaatcacttgaa

SEQ ID NO: 123375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaatctgggaggcagaggtt

SEQ ID NO: 123376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatctgggaggcagaggttg

SEQ ID NO: 123377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaggcagaggttgcagcga

SEQ ID NO: 123378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagcgagccaacatcgtacc

SEQ ID NO: 123379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cactccagcctgggcaacag

SEQ ID NO: 123380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagcctgggcaacagagtga

SEQ ID NO: 123381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcaacagagtgaaaccggc

SEQ ID NO: 123382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacctatgtaaaaaacctgc

SEQ ID NO: 123383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acctatgtaaaaaacctgca

SEQ ID NO: 123384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctatgtaaaaaacctgcac

SEQ ID NO: 123385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtaaaaaacctgcacatcc

SEQ ID NO: 123386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cacatcctgcaaatgtacct

SEQ ID NO: 123387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caaatgtaccttgaaactta

SEQ ID NO: 123388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaacttaattaaaaaaaaa

SEQ ID NO: 123389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaacttaattaaaaaaaaaa

SEQ ID NO: 123390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aattaaaaaaaaaaaaaaaa

SEQ ID NO: 123391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attaaaaaaaaaaaaaaaaa

SEQ ID NO: 123392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaaaaaaaaaaaagagg

SEQ ID NO: 123393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcatggtggctcacgccta

SEQ ID NO: 123394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acgcctataatcccagcact

SEQ ID NO: 123395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatcccagcactttggggg

SEQ ID NO: 123396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggggggcctaggcgggcag

SEQ ID NO: 123397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggggggcctaggcgggcaga

SEQ ID NO: 123398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggggcctaggcgggcagat

SEQ ID NO: 123399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggcgggcagatcacctgaac

SEQ ID NO: 123400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aactcaggagttcaagacca

SEQ ID NO: 123401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggagttcaagaccagcctg

SEQ ID NO: 123402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagaccagcctgcccaacct

SEQ ID NO: 123403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cccaacctggtgaaatccta

SEQ ID NO: 123404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtgaaatcctatctctacta

SEQ ID NO: 123405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctctactaaaaatacaaaa

SEQ ID NO: 123406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tactaaaaatacaaaattag

SEQ ID NO: 123407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaaaaatacaaaattagcc

SEQ ID NO: 123408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaatacaaaattagccagg

SEQ ID NO: 123409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccaggcgaggtggctcatg

SEQ ID NO: 123410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgcctgtaatcccggctac

SEQ ID NO: 123411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taatcccggctactcgggag

SEQ ID NO: 123412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcgggaggctgaggcagga

SEQ ID NO: 123413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gggaggctgaggcaggagaa

SEQ ID NO: 123414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggcaggagaattgcttgaa

SEQ ID NO: 123415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttgaacctgggaggcggaa

SEQ ID NO: 123416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaacctgggaggcggaagtt

SEQ ID NO: 123417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacctgggaggcggaagttg

SEQ ID NO: 123418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaggcggaagttgcagtga

SEQ ID NO: 123419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagtgagccaagatcgtacc

SEQ ID NO: 123420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cactccagcctgggcaacaa

SEQ ID NO: 123421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagcctgggcaacaagagtg

SEQ ID NO: 123422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcaacaagagtgaaactcg

SEQ ID NO: 123423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggtctcaaaaaaaaaaaaaa

SEQ ID NO: 123424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaaaaaaaaaaaagaatgc

SEQ ID NO: 123425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgattataatattctaagtt

SEQ ID NO: 123426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gattataatattctaagtta

SEQ ID NO: 123427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attataatattctaagttat

SEQ ID NO: 123428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatattctaagttattaaa

SEQ ID NO: 123429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taagttattaaatgcctaga

SEQ ID NO: 123430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agttattaaatgcctagata

SEQ ID NO: 123431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaatgcctagataccatt

SEQ ID NO: 123432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgcctagataccattatt

SEQ ID NO: 123433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gataccattattgaacatct

SEQ ID NO: 123434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgaacatctactcatatct

SEQ ID NO: 123435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacatctactcatatctact

SEQ ID NO: 123436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcatatctacttatcatgt

SEQ ID NO: 123437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atatctacttatcatgtgta

SEQ ID NO: 123438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttatcatgtgtaagacact

SEQ ID NO: 123439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atcatgtgtaagacactaaa

SEQ ID NO: 123440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcatgtgtaagacactaaag

SEQ ID NO: 123441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtggctgttttggaaaaa

SEQ ID NO: 123442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttggaaaaaacaaattac

SEQ ID NO: 123443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggaaaaaacaaattacgat

SEQ ID NO: 123444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaaaaaacaaattacgatg

SEQ ID NO: 123445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaaaaacaaattacgatgt

SEQ ID NO: 123446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cgatgtatatacatatatat

SEQ ID NO: 123447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctaatatataatatactcta

SEQ ID NO: 123448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atatataatatactctatat

SEQ ID NO: 123449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatatataacatataatata

SEQ ID NO: 123450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatataacatataatatagt

SEQ ID NO: 123451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaagtaaatactactaatt

SEQ ID NO: 123452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaagtaaatactactaattt

SEQ ID NO: 123453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaatttacaggaaagcaat

SEQ ID NO: 123454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttacaggaaagcaatatt

SEQ ID NO: 123455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaggaaagcaatatttaag

SEQ ID NO: 123456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caggaaagcaatatttaaga

SEQ ID NO: 123457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagaaattaatatttgacta

SEQ ID NO: 123458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaaattaatatttgactaa

SEQ ID NO: 123459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatttgactaagaccacat

SEQ ID NO: 123460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gactaagaccacatactgag

SEQ ID NO: 123461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actaagaccacatactgagt

SEQ ID NO: 123462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaccacatactgagtaaag

SEQ ID NO: 123463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtaaaggaaatatttggga

SEQ ID NO: 123464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggaaaaataaacttccttt

SEQ ID NO: 123465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaaaaataaacttcctttc

SEQ ID NO: 123466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctttcactatactaatttg

SEQ ID NO: 123467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttcactatactaatttga

SEQ ID NO: 123468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcactatactaatttgaact

SEQ ID NO: 123469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cactatactaatttgaactc

SEQ ID NO: 123470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actatactaatttgaactca

SEQ ID NO: 123471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tactaatttgaactcaaatt

SEQ ID NO: 123472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttgaactcaaatttattt

SEQ ID NO: 123473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaactcaaatttatttatct

SEQ ID NO: 123474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aactcaaatttatttatctg

SEQ ID NO: 123475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaatttatttatctgtgctt

SEQ ID NO: 123476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatctgtgcttttaaca

SEQ ID NO: 123477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatctgtgcttttaacac

SEQ ID NO: 123478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctgtgcttttaacacttt

SEQ ID NO: 123479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgtgcttttaacacttta

SEQ ID NO: 123480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgcttttaacactttataaa

SEQ ID NO: 123481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaacactttataaaaatat

SEQ ID NO: 123482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacactttataaaaatatt

SEQ ID NO: 123483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacactttataaaaatattt

SEQ ID NO: 123484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acactttataaaaatatttt

SEQ ID NO: 123485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tataaaaatattttacagtc

SEQ ID NO: 123486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataaaaatattttacagtct

SEQ ID NO: 123487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaaaatattttacagtctg

SEQ ID NO: 123488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacagtctgaaatatagtag

SEQ ID NO: 123489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acagtctgaaatatagtaga

SEQ ID NO: 123490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagtctgaaatatagtagag

SEQ ID NO: 123491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaatatagtagagatgtaat

SEQ ID NO: 123492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaaaggcacttctctgcct

SEQ ID NO: 123493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaggcacttctctgccta

SEQ ID NO: 123494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaggcacttctctgcctag

SEQ ID NO: 123495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctctgcctagctgttctaca

SEQ ID NO: 123496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgcctagctgttctacaa

SEQ ID NO: 123497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcctagctgttctacaagt

SEQ ID NO: 123498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctagctgttctacaagtgt

SEQ ID NO: 123499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctgttctacaagtgttcat

SEQ ID NO: 123500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttctacaagtgttcattcct

SEQ ID NO: 123501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacaagtgttcattcctaaa

SEQ ID NO: 123502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caagtgttcattcctaaaag

SEQ ID NO: 123503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attcctaaaagtctgtcagc

SEQ ID NO: 123504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctaaaagtctgtcagctgat

SEQ ID NO: 123505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaagtctgtcagctgatctc

SEQ ID NO: 123506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcagctgatctcatgggatt

SEQ ID NO: 123507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atctcatgggattataagaa

SEQ ID NO: 123508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgggattataagaacctta

SEQ ID NO: 123509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taagaaccttattcccagtt

SEQ ID NO: 123510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attcccagttgatccctgag

SEQ ID NO: 123511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcccagttgatccctgagt

SEQ ID NO: 123512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccagttgatccctgagtagg

SEQ ID NO: 123513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atccctgagtaggccacttc

SEQ ID NO: 123514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtaggccacttcccttttt

SEQ ID NO: 123515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctttttcctacctgaatt

SEQ ID NO: 123516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctttttcctacctgaatta

SEQ ID NO: 123517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttcctacctgaattaccat

SEQ ID NO: 123518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcctacctgaattaccatg

SEQ ID NO: 123519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctacctgaattaccatga

SEQ ID NO: 123520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctacctgaattaccatgag

SEQ ID NO: 123521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctacctgaattaccatgagc

SEQ ID NO: 123522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctgaattaccatgagccaa

SEQ ID NO: 123523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aattaccatgagccaagttt

SEQ ID NO: 123524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccatgagccaagtttgtaaa

SEQ ID NO: 123525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaaatggggtaacaagaat

SEQ ID NO: 123526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaatggggtaacaagaata

SEQ ID NO: 123527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttaagagggaaacaaatt

SEQ ID NO: 123528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttaagagggaaacaaattc

SEQ ID NO: 123529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaagagggaaacaaattca

SEQ ID NO: 123530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agagggaaacaaattcatca

SEQ ID NO: 123531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcacttcaactttataata

SEQ ID NO: 123532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caactttataatattttgtt

SEQ ID NO: 123533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aactttataatattttgttc

SEQ ID NO: 123534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tataatattttgttccatgc

SEQ ID NO: 123535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataatattttgttccatgca

SEQ ID NO: 123536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatattttgttccatgcaa

SEQ ID NO: 123537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttccatgcaaagatcatt

SEQ ID NO: 123538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttccatgcaaagatcattt

SEQ ID NO: 123539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttccatgcaaagatcattta

SEQ ID NO: 123540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catgcaaagatcatttacaa

SEQ ID NO: 123541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaaagattggtcccataat

SEQ ID NO: 123542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaagattggtcccataata

SEQ ID NO: 123543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtcccataatatttacctag

SEQ ID NO: 123544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acctagaaggaatcactcag

SEQ ID NO: 123545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctagaaggaatcactcaga

SEQ ID NO: 123546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaggaatcactcagataaa

SEQ ID NO: 123547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agataaaggcatcacttacc

SEQ ID NO: 123548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
accaataaagcatttaattc

SEQ ID NO: 123549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccaataaagcatttaattca

SEQ ID NO: 123550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattcatcctattcaaaatg

SEQ ID NO: 123551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attcatcctattcaaaatgt

SEQ ID NO: 123552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcctattcaaaatgtcctc

SEQ ID NO: 123553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttcaaaatgtcctcaataaa

SEQ ID NO: 123554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaatgtcctcaataaatta

SEQ ID NO: 123555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aataaattatctttactctg

SEQ ID NO: 123556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctttactctgagccctaaa

SEQ ID NO: 123557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tactctgagccctaaaagat

SEQ ID NO: 123558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actctgagccctaaaagata

SEQ ID NO: 123559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctctgagccctaaaagatac

SEQ ID NO: 123560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgagccctaaaagatacact

SEQ ID NO: 123561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agccctaaaagatacactgt

SEQ ID NO: 123562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaagatacactgtctattag

SEQ ID NO: 123563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctattagacttgaaagaat

SEQ ID NO: 123564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttagacttgaaagaatagtc

SEQ ID NO: 123565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gacttgaaagaatagtcatt

SEQ ID NO: 123566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaagaatagtcatttagta

SEQ ID NO: 123567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaagaatagtcatttagtag

SEQ ID NO: 123568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtagagcttaaatcaatat

SEQ ID NO: 123569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtagagcttaaatcaatata

SEQ ID NO: 123570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaatcaatatatgaaatata

SEQ ID NO: 123571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatcaatatatgaaatataa

SEQ ID NO: 123572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatttttttgtagaaacag

SEQ ID NO: 123573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttttttgtagaaacaga

SEQ ID NO: 123574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttttttgtagaaacagat

SEQ ID NO: 123575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttgtagaaacagattttc

SEQ ID NO: 123576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgtagaaacagattttcc

SEQ ID NO: 123577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtagaaacagattttcct

SEQ ID NO: 123578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtagaaacagattttcctt

SEQ ID NO: 123579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtagaaacagattttccttt

SEQ ID NO: 123580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagaaacagattttcctttt

SEQ ID NO: 123581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccttttattgcccaggctg

SEQ ID NO: 123582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttttattgcccaggctga

SEQ ID NO: 123583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttttattgcccaggctgat

SEQ ID NO: 123584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttattgcccaggctgatcta

SEQ ID NO: 123585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattgcccaggctgatctag

SEQ ID NO: 123586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgcccaggctgatctaga

SEQ ID NO: 123587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgcccaggctgatctagaa

SEQ ID NO: 123588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccaggctgatctagaactc

SEQ ID NO: 123589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atctagaactcctggatcaa

SEQ ID NO: 123590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaactcctggatcaagcaat

SEQ ID NO: 123591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctggatcaagcaatcctcca

SEQ ID NO: 123592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatcaagcaatcctccagcc

SEQ ID NO: 123593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagcctcggcctcccaaagt

SEQ ID NO: 123594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggcctcccaaagtgatggga

SEQ ID NO: 123595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaaagtgatgggattgcag

SEQ ID NO: 123596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caggggtgaccagctgtgcc

SEQ ID NO: 123597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgcctgacataatattttat

SEQ ID NO: 123598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acataatattttattatcat

SEQ ID NO: 123599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattatcatgaaacattttt

SEQ ID NO: 123600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attatcatgaaacatttttc

SEQ ID NO: 123601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatcatgaaacatttttct

SEQ ID NO: 123602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcatgaaacatttttctcat

SEQ ID NO: 123603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctcatttttccctgtttt

SEQ ID NO: 123604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctcatttttccctgtttta

SEQ ID NO: 123605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcatttttccctgttttac

SEQ ID NO: 123606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcatttttccctgttttact

SEQ ID NO: 123607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atttttccctgttttactca

SEQ ID NO: 123608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccctgttttactcatctg

SEQ ID NO: 123609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccctgttttactcatctgc

SEQ ID NO: 123610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctgttttactcatctgca

SEQ ID NO: 123611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctgttttactcatctgcat

SEQ ID NO: 123612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttactcatctgcatggat

SEQ ID NO: 123613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tactcatctgcatggatttg

SEQ ID NO: 123614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actcatctgcatggatttga

SEQ ID NO: 123615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcatctgcatggatttgaa

SEQ ID NO: 123616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atctgcatggatttgaatat

SEQ ID NO: 123617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catggatttgaatatctaca

SEQ ID NO: 123618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaatatctacatttacttct

SEQ ID NO: 123619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatatctacatttacttctt

SEQ ID NO: 123620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catttacttcttttttcaaa

SEQ ID NO: 123621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttcttttttcaaattcta

SEQ ID NO: 123622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttcttttttcaaattctaa

SEQ ID NO: 123623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttttttcaaattctaaagt

SEQ ID NO: 123624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttttcaaattctaaagta

SEQ ID NO: 123625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttcaaattctaaagtata

SEQ ID NO: 123626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcaaattctaaagtatag

SEQ ID NO: 123627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcaaattctaaagtataga

SEQ ID NO: 123628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaattctaaagtatagac

SEQ ID NO: 123629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaattctaaagtatagact

SEQ ID NO: 123630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaattctaaagtatagactc

SEQ ID NO: 123631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaagtatagactctcaaga

SEQ ID NO: 123632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtatagactctcaagaag

SEQ ID NO: 123633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaagaagatgacatatttt

SEQ ID NO: 123634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagaagatgacatattttta

SEQ ID NO: 123635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaataattacattggat

SEQ ID NO: 123636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaataattacattggatt

SEQ ID NO: 123637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaataattacattggattt

SEQ ID NO: 123638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaataattacattggattta

SEQ ID NO: 123639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cattggatttaaaaacatat

SEQ ID NO: 123640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gatttaaaaacatatagtgt

SEQ ID NO: 123641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaacatatagtgtaggag

SEQ ID NO: 123642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaacatatagtgtaggagc

SEQ ID NO: 123643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtaaaagttgacagatacca

SEQ ID NO: 123644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acagataccacatccagtga

SEQ ID NO: 123645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccccagttaaaataataat

SEQ ID NO: 123646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaataataataataataata

SEQ ID NO: 123647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gataatgggctgagcgcggt

SEQ ID NO: 123648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agcgcggtggctcatgcttg

SEQ ID NO: 123649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgcttgtaatcccagcact

SEQ ID NO: 123650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaatcccagcactttggga

SEQ ID NO: 123651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatcccagcactttgggag

SEQ ID NO: 123652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgggaggtcgaggcgggcgg

SEQ ID NO: 123653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggaggtcgaggcgggcgga

SEQ ID NO: 123654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaggtcgaggcgggcggat

SEQ ID NO: 123655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtcaggagattgagaccat

SEQ ID NO: 123656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaccatcctggctaacatg

SEQ ID NO: 123657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctaacatggtgaaactccg

SEQ ID NO: 123658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acatggtgaaactccgtctc

SEQ ID NO: 123659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cgtctctactaaaaatacaa

SEQ ID NO: 123660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tactaaaaatacaaaaacat

SEQ ID NO: 123661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaaaaatacaaaaacatta

SEQ ID NO: 123662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaatacaaaaacattagcc

SEQ ID NO: 123663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccgggcacggtggtaggcg

SEQ ID NO: 123664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagtcccagctactcggagg

SEQ ID NO: 123665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcggaggctgaggcaggag

SEQ ID NO: 123666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggaggctgaggcaggagaat

SEQ ID NO: 123667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggcaggagaatggtgtgaa

SEQ ID NO: 123668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcagtgagccaagatcgcgc

SEQ ID NO: 123669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagtgagccaagatcgcgcc

SEQ ID NO: 123670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cactccagcctgggcgacag

SEQ ID NO: 123671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagcctgggcgacagagcga

SEQ ID NO: 123672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcgacagagcgagactccg

SEQ ID NO: 123673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cgtctcaaaaaaataaaaaa

SEQ ID NO: 123674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaaaaataaaaaataaaaa

SEQ ID NO: 123675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaaaatcagataatacagg

SEQ ID NO: 123676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaatcagataatacaggg

SEQ ID NO: 123677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatcagataatacaggga

SEQ ID NO: 123678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtgtgcatatagcacataa

SEQ ID NO: 123679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattaaaaatcttatggga

SEQ ID NO: 123680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattaaaaatcttatgggaa

SEQ ID NO: 123681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaaaaatcttatgggaat

SEQ ID NO: 123682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaaaatcttatgggaatg

SEQ ID NO: 123683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatcttatgggaatgttt

SEQ ID NO: 123684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgggaatgtttttaatact

SEQ ID NO: 123685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgggaatgtttttaatactt

SEQ ID NO: 123686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaatacttatattttaatg

SEQ ID NO: 123687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatacttatattttaatgc

SEQ ID NO: 123688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatacttatattttaatgca

SEQ ID NO: 123689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atacttatattttaatgcat

SEQ ID NO: 123690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atattttaatgcatgcttct

SEQ ID NO: 123691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattttaatgcatgcttcta

SEQ ID NO: 123692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatgcatgcttctaatctt

SEQ ID NO: 123693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatgcatgcttctaatctta

SEQ ID NO: 123694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgcatgcttctaatcttat

SEQ ID NO: 123695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaatcttatttatctttct

SEQ ID NO: 123696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taatcttatttatctttctt

SEQ ID NO: 123697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atcttatttatctttcttta

SEQ ID NO: 123698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttatctttctttagaggc

SEQ ID NO: 123699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatctttctttagaggct

SEQ ID NO: 123700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctttctttagaggctcaa

SEQ ID NO: 123701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctttctttagaggctcaat

SEQ ID NO: 123702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttagaggctcaattttc

SEQ ID NO: 123703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttagaggctcaattttcc

SEQ ID NO: 123704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttagaggctcaattttcca

SEQ ID NO: 123705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagaggctcaattttccaat

SEQ ID NO: 123706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaggctcaattttccaatt

SEQ ID NO: 123707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaggctcaattttccaatta

SEQ ID NO: 123708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aattttccaattatttgtac

SEQ ID NO: 123709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccaattatttgtactaata

SEQ ID NO: 123710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaattatttgtactaatag

SEQ ID NO: 123711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caattatttgtactaatagt

SEQ ID NO: 123712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgtactaatagtttgacc

SEQ ID NO: 123713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtactaatagtttgacctaa

SEQ ID NO: 123714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tactaatagtttgacctaaa

SEQ ID NO: 123715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atagtttgacctaaaagtgg

SEQ ID NO: 123716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacctaaaagtggagtaaaa

SEQ ID NO: 123717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acctaaaagtggagtaaaat

SEQ ID NO: 123718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaagtggagtaaaatttgcc

SEQ ID NO: 123719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccttactggcgtacatatc

SEQ ID NO: 123720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccttactggcgtacatatca

SEQ ID NO: 123721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actggcgtacatatcaaaca

SEQ ID NO: 123722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctggcgtacatatcaaacat

SEQ ID NO: 123723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcgtacatatcaaacatttg

SEQ ID NO: 123724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaagatgagatgtaggaga

SEQ ID NO: 123725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaagatgagatgtaggagag

SEQ ID NO: 123726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attgcagggcaggatgctaa

SEQ ID NO: 123727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagggcaggatgctaactta

SEQ ID NO: 123728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acttaattgtaaatgtacac

SEQ ID NO: 123729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aattgtaaatgtacacactc

SEQ ID NO: 123730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attgtaaatgtacacactct

SEQ ID NO: 123731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaatgtacacactctttct

SEQ ID NO: 123732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttctaaatttccaagtgaa

SEQ ID NO: 123733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctaaatttccaagtgaaca

SEQ ID NO: 123734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaaatttccaagtgaacaa

SEQ ID NO: 123735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaatttccaagtgaacaat

SEQ ID NO: 123736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatttccaagtgaacaatcc

SEQ ID NO: 123737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaagtgaacaatcctaggt

SEQ ID NO: 123738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caagtgaacaatcctaggtg

SEQ ID NO: 123739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtgcaattagagctttatt

SEQ ID NO: 123740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagctttattgtattttgat

SEQ ID NO: 123741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattgtattttgataaatga

SEQ ID NO: 123742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgtattttgataaatgat

SEQ ID NO: 123743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgtattttgataaatgatt

SEQ ID NO: 123744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattttgataaatgattcag

SEQ ID NO: 123745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgataaatgattcagaaagc

SEQ ID NO: 123746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gataaatgattcagaaagct

SEQ ID NO: 123747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataaatgattcagaaagctt

SEQ ID NO: 123748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaaagctttgtaaaaaatc

SEQ ID NO: 123749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtaaaaaatccaaggagac

SEQ ID NO: 123750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaaaaaatccaaggagaca

SEQ ID NO: 123751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaaaaatccaaggagacat

SEQ ID NO: 123752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaagaaatttatgatcagt

SEQ ID NO: 123753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagaaatttatgatcagta

SEQ ID NO: 123754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagaaatttatgatcagtaa

SEQ ID NO: 123755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgatcagtaatagcagtct

SEQ ID NO: 123756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgatcagtaatagcagtctc

SEQ ID NO: 123757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctaacacttgacataacaa

SEQ ID NO: 123758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taacacttgacataacaaga

SEQ ID NO: 123759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acacttgacataacaagagg

SEQ ID NO: 123760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacataacaagaggaaatca

SEQ ID NO: 123761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acataacaagaggaaatcat

SEQ ID NO: 123762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagttaaagtaacgttaggt

SEQ ID NO: 123763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtaacgttaggtttcaac

SEQ ID NO: 123764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtttcaacagtaatatatg

SEQ ID NO: 123765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caacagtaatatatggcatt

SEQ ID NO: 123766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacagtaatatatggcattt

SEQ ID NO: 123767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttggctccatgttatatcac

SEQ ID NO: 123768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggctccatgttatatcact

SEQ ID NO: 123769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggctccatgttatatcactt

SEQ ID NO: 123770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctccatgttatatcacttt

SEQ ID NO: 123771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catgttatatcactttaaaa

SEQ ID NO: 123772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatcactttaaaaaatctaa

SEQ ID NO: 123773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaaaaatctaaagatagtt

SEQ ID NO: 123774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaatctaaagatagttc

SEQ ID NO: 123775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaatctaaagatagttca

SEQ ID NO: 123776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagatagttcatctcctgtg

SEQ ID NO: 123777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atctcctgtgttaaagaaac

SEQ ID NO: 123778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgtgttaaagaaacaacaa

SEQ ID NO: 123779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgttaaagaaacaacaacaa

SEQ ID NO: 123780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagaaacaacaacaacatat

SEQ ID NO: 123781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgcttacagtaagttgtt

SEQ ID NO: 123782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgcttacagtaagttgtta

SEQ ID NO: 123783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcttacagtaagttgttat

SEQ ID NO: 123784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttacagtaagttgttatt

SEQ ID NO: 123785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttacagtaagttgttattt

SEQ ID NO: 123786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acagtaagttgttattttaa

SEQ ID NO: 123787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagtaagttgttattttaaa

SEQ ID NO: 123788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttattttaaaaagagacgtg

SEQ ID NO: 123789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaaaaagagacgtggaa

SEQ ID NO: 123790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaagagacgtggaaaga

SEQ ID NO: 123791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaagagacgtggaaagaa

SEQ ID NO: 123792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaagagacgtggaaagaac

SEQ ID NO: 123793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctctatagaactaaaaaga

SEQ ID NO: 123794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctatagaactaaaaagat

SEQ ID NO: 123795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctatagaactaaaaagata

SEQ ID NO: 123796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatagaactaaaaagatata

SEQ ID NO: 123797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagaactaaaaagatataga

SEQ ID NO: 123798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaagatatagaataattca

SEQ ID NO: 123799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agttctacatatgtcaattc

SEQ ID NO: 123800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacatatgtcaattcaaact

SEQ ID NO: 123801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catatgtcaattcaaacttg

SEQ ID NO: 123802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaacttgtctgtggcagatt

SEQ ID NO: 123803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtctgtggcagattatgctt

SEQ ID NO: 123804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctgtggcagattatgctta

SEQ ID NO: 123805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggcagattatgcttactgg

SEQ ID NO: 123806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcttactggcactgttcaa

SEQ ID NO: 123807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actggcactgttcaaggcat

SEQ ID NO: 123808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctggcactgttcaaggcatt

SEQ ID NO: 123809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcactgttcaaggcattccc

SEQ ID NO: 123810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttcaaggcattcccctcttc

SEQ ID NO: 123811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaggcattcccctcttcctt

SEQ ID NO: 123812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccctcttccttccccacttt

SEQ ID NO: 123813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttccttccccactttatcat

SEQ ID NO: 123814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttccccactttatcatgg

SEQ ID NO: 123815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttccccactttatcatggc

SEQ ID NO: 123816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccccactttatcatggcctg

SEQ ID NO: 123817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccactttatcatggcctgg

SEQ ID NO: 123818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatcatggcctggcattttt

SEQ ID NO: 123819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcatggcctggcatttttc

SEQ ID NO: 123820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcatggcctggcatttttcc

SEQ ID NO: 123821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcatttttcctcaccaccca

SEQ ID NO: 123822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcctcaccacccagaaggg

SEQ ID NO: 123823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctcaccacccagaagggt

SEQ ID NO: 123824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctcaccacccagaagggtt

SEQ ID NO: 123825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcaccacccagaagggttt

SEQ ID NO: 123826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
accacccagaagggtttcat

SEQ ID NO: 123827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattcctccaaacttcattc

SEQ ID NO: 123828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attcctccaaacttcattcc

SEQ ID NO: 123829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctccaaacttcattccacct

SEQ ID NO: 123830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caaacttcattccaccttta

SEQ ID NO: 123831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cattccacctttagctgcca

SEQ ID NO: 123832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attccacctttagctgccaa

SEQ ID NO: 123833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacctttagctgccaagagc

SEQ ID NO: 123834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagctgccaagagctgatgg

SEQ ID NO: 123835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agctgccaagagctgatggc

SEQ ID NO: 123836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctgccaagagctgatggct

SEQ ID NO: 123837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccaagagctgatggcttttt

SEQ ID NO: 123838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atggctttttcttttgccta

SEQ ID NO: 123839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttcttttgcctaaagccat

SEQ ID NO: 123840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttttgcctaaagccatt

SEQ ID NO: 123841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttttgcctaaagccattt

SEQ ID NO: 123842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttgcctaaagccatttc

SEQ ID NO: 123843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttgcctaaagccatttcc

SEQ ID NO: 123844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgcctaaagccatttcctt

SEQ ID NO: 123845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcctaaagccatttccttc

SEQ ID NO: 123846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcctaaagccatttccttcc

SEQ ID NO: 123847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctaaagccatttccttcca

SEQ ID NO: 123848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagccatttccttccagcaa

SEQ ID NO: 123849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttccagcaaggcagagga

SEQ ID NO: 123850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttccagcaaggcagaggaa

SEQ ID NO: 123851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccagcaaggcagaggaaagg

SEQ ID NO: 123852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagcaaggcagaggaaaggg

SEQ ID NO: 123853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caatgaagaaatttcatttt

SEQ ID NO: 123854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgaagaaatttcattttt

SEQ ID NO: 123855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattttttagaatggcagga

SEQ ID NO: 123856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attttttagaatggcaggac

SEQ ID NO: 123857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttagaatggcaggacacca

SEQ ID NO: 123858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagaatggcaggacaccaa

SEQ ID NO: 123859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagaatggcaggacaccaaa

SEQ ID NO: 123860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaatggcaggacaccaaaa

SEQ ID NO: 123861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatggcaggacaccaaaat

SEQ ID NO: 123862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttatctcatattccacaaaa

SEQ ID NO: 123863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctcatattccacaaaagta

SEQ ID NO: 123864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atattccacaaaagtattct

SEQ ID NO: 123865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacaaaagtattctacccac

SEQ ID NO: 123866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacccacattctctggatgc

SEQ ID NO: 123867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cccacattctctggatgctc

SEQ ID NO: 123868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctggatgctctcataaatc

SEQ ID NO: 123869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tggatgctctcataaatcct

SEQ ID NO: 123870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatgctctcataaatcctca

SEQ ID NO: 123871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcataaatcctcatataaaa

SEQ ID NO: 123872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataaatcctcatataaaata

SEQ ID NO: 123873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atataaaatatttttataca

SEQ ID NO: 123874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatacaattttataatatc

SEQ ID NO: 123875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatacaattttataatatct

SEQ ID NO: 123876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atacaattttataatatcta

SEQ ID NO: 123877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacaattttataatatctat

SEQ ID NO: 123878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tataatatctattttaatat

SEQ ID NO: 123879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataatatctattttaatatg

SEQ ID NO: 123880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatatctattttaatatga

SEQ ID NO: 123881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttaatatgaccttgcctc

SEQ ID NO: 123882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatatgaccttgcctctca

SEQ ID NO: 123883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatatgaccttgcctctcaa

SEQ ID NO: 123884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatgaccttgcctctcaag

SEQ ID NO: 123885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcctctcaagtggtaatcta

SEQ ID NO: 123886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctctcaagtggtaatctaa

SEQ ID NO: 123887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaagtggtaatctaactct

SEQ ID NO: 123888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagtggtaatctaactctac

SEQ ID NO: 123889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actctacacagttctaaagg

SEQ ID NO: 123890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tacacagttctaaaggaaga

SEQ ID NO: 123891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacagttctaaaggaagatg

SEQ ID NO: 123892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaaggaagatgtcataata

SEQ ID NO: 123893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaggaagatgtcataatact

SEQ ID NO: 123894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgtaaagaataaattagct

SEQ ID NO: 123895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtaaagaataaattagcta

SEQ ID NO: 123896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaagaataaattagctaat

SEQ ID NO: 123897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctaatttgtgatgtgtaat

SEQ ID NO: 123898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttgtgatgtgtaatatga

SEQ ID NO: 123899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgatgtgtaatatgaagga

SEQ ID NO: 123900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgatgtgtaatatgaaggac

SEQ ID NO: 123901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caattagtacacagatgccc

SEQ ID NO: 123902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aattagtacacagatgccct

SEQ ID NO: 123903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtacacagatgccctccaat

SEQ ID NO: 123904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caatacaacatccacaatat

SEQ ID NO: 123905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcagagcaaatttttaaaa

SEQ ID NO: 123906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagagcaaatttttaaaaat

SEQ ID NO: 123907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agagcaaatttttaaaaatc

SEQ ID NO: 123908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaaatccctgctcacaa

SEQ ID NO: 123909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaatccctgctcacaat

SEQ ID NO: 123910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaatccctgctcacaatt

SEQ ID NO: 123911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatccctgctcacaatta

SEQ ID NO: 123912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctcacaattagtgaaataat

SEQ ID NO: 123913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acaattagtgaaataattta

SEQ ID NO: 123914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgaaataatttagtccttc

SEQ ID NO: 123915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtccttcaagatgtaatgt

SEQ ID NO: 123916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtccttcaagatgtaatgtg

SEQ ID NO: 123917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caagatgtaatgtggtaacc

SEQ ID NO: 123918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagatgtaatgtggtaacca

SEQ ID NO: 123919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaccaaaaatctgtggct

SEQ ID NO: 123920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
accaaaaatctgtggctggc

SEQ ID NO: 123921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccaaaaatctgtggctggcc

SEQ ID NO: 123922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggctggccatttgctacat

SEQ ID NO: 123923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gccatttgctacataaaaaa

SEQ ID NO: 123924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctacataaaaaaatcatta

SEQ ID NO: 123925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctacataaaaaaatcattaa

SEQ ID NO: 123926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cataaaaaaatcattaatca

SEQ ID NO: 123927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcagtttgtcacctaattg

SEQ ID NO: 123928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcacctaattgaaagctaa

SEQ ID NO: 123929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcacctaattgaaagctaaa

SEQ ID NO: 123930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attgaaagctaaattttcaa

SEQ ID NO: 123931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaagctaaattttcaaccaa

SEQ ID NO: 123932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattttcaaccaaatgttaa

SEQ ID NO: 123933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaccaaatgttaatagca

SEQ ID NO: 123934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaccaaatgttaatagcaa

SEQ ID NO: 123935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaccaaatgttaatagcaaa

SEQ ID NO: 123936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atagcaaaactagttgtttg

SEQ ID NO: 123937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gttgtttgtttaatatcttt

SEQ ID NO: 123938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgtttaatatctttaagc

SEQ ID NO: 123939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttaatatctttaagcata

SEQ ID NO: 123940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttaatatctttaagcatag

SEQ ID NO: 123941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatatctttaagcatagtct

SEQ ID NO: 123942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatctttaagcatagtctg

SEQ ID NO: 123943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taagcatagtctgcaaaaat

SEQ ID NO: 123944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagcatagtctgcaaaaata

SEQ ID NO: 123945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcatagtctgcaaaaataa

SEQ ID NO: 123946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caaaaataaaggggggaggc

SEQ ID NO: 123947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagtatgaaaatgacacaat

SEQ ID NO: 123948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtatgaaaatgacacaatca

SEQ ID NO: 123949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgagcatgaagtttgcagt

SEQ ID NO: 123950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgagcatgaagtttgcagtc

SEQ ID NO: 123951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcagtccttacttccactct

SEQ ID NO: 123952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagtccttacttccactcta

SEQ ID NO: 123953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acttccactctaataacagt

SEQ ID NO: 123954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttccactctaataacagtg

SEQ ID NO: 123955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccactctaataacagtgatg

SEQ ID NO: 123956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cactctaataacagtgatgg

SEQ ID NO: 123957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taataacagtgatgggtctt

SEQ ID NO: 123958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ataacagtgatgggtcttca

SEQ ID NO: 123959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catggataagcccacattgc

SEQ ID NO: 123960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atggataagcccacattgcc

SEQ ID NO: 123961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctctctgaaccttccttag

SEQ ID NO: 123962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctgaaccttccttagagaa

SEQ ID NO: 123963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgaaccttccttagagaatg

SEQ ID NO: 123964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaccttccttagagaatgct

SEQ ID NO: 123965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttagagaatgcttcaaat

SEQ ID NO: 123966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttagagaatgcttcaaata

SEQ ID NO: 123967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agagaatgcttcaaatattt

SEQ ID NO: 123968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagaatgcttcaaatatttg

SEQ ID NO: 123969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaatatttggataatgtgc

SEQ ID NO: 123970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaatatttggataatgtgcc

SEQ ID NO: 123971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggataatgtgccctttgtac

SEQ ID NO: 123972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gataatgtgccctttgtacc

SEQ ID NO: 123973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtacctggggcaaacatca

SEQ ID NO: 123974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtacctggggcaaacatcaa

SEQ ID NO: 123975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tacctggggcaaacatcaat

SEQ ID NO: 123976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gggcaaacatcaatttagac

SEQ ID NO: 123977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaccgtgtggaaacctaac

SEQ ID NO: 123978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaccgtgtggaaacctaact

SEQ ID NO: 123979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acttatggcctccgcctcat

SEQ ID NO: 123980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atggcctccgcctcatctga

SEQ ID NO: 123981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggcctccgcctcatctgac

SEQ ID NO: 123982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cgcctcatctgactacattt

SEQ ID NO: 123983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atctgactacatttctatca

SEQ ID NO: 123984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actacatttctatcaactga

SEQ ID NO: 123985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catttctatcaactgagctc

SEQ ID NO: 123986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatcaactgagctcacata

SEQ ID NO: 123987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatcaactgagctcacataa

SEQ ID NO: 123988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaactgagctcacataagc

SEQ ID NO: 123989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agctcacataagcatctatg

SEQ ID NO: 123990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acataagcatctatgtttat

SEQ ID NO: 123991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtttattttaaaagaatat

SEQ ID NO: 123992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttaaaagaatattttaa

SEQ ID NO: 123993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaaaagaatattttaaa

SEQ ID NO: 123994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaagaatattttaaattc

SEQ ID NO: 123995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaagaatattttaaattca

SEQ ID NO: 123996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagaatattttaaattcat

SEQ ID NO: 123997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaattcatagtcagtgact

SEQ ID NO: 123998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattcatagtcagtgacta

SEQ ID NO: 123999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattcatagtcagtgactat

SEQ ID NO: 124000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atagtcagtgactattgact

SEQ ID NO: 124001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgactggccctcaaatttc

SEQ ID NO: 124002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actggccctcaaatttctgt

SEQ ID NO: 124003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gccctcaaatttctgttaga

SEQ ID NO: 124004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaatttctgttagatgatac

SEQ ID NO: 124005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgttagatgatacagattt

SEQ ID NO: 124006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttagatgatacagattta

SEQ ID NO: 124007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttagatgatacagatttaaa

SEQ ID NO: 124008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatgatacagatttaaacct

SEQ ID NO: 124009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaacctaacaaggttatcat

SEQ ID NO: 124010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacctaacaaggttatcatt

SEQ ID NO: 124011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acaaggttatcattttagat

SEQ ID NO: 124012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcattttagatttggagtca

SEQ ID NO: 124013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagatttggagtcacttata

SEQ ID NO: 124014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agatttggagtcacttataa

SEQ ID NO: 124015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatttggagtcacttataac

SEQ ID NO: 124016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggagtcacttataaccatat

SEQ ID NO: 124017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagtcacttataaccatatt

SEQ ID NO: 124018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataaccatattagtttatgc

SEQ ID NO: 124019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaccatattagtttatgca

SEQ ID NO: 124020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtttatgcaatccaattttt

SEQ ID NO: 124021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgcaatccaattttttctt

SEQ ID NO: 124022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcaatccaattttttctta

SEQ ID NO: 124023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcttaaaatatattttaa

SEQ ID NO: 124024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttaaaatatattttaat

SEQ ID NO: 124025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttaaaatatattttaata

SEQ ID NO: 124026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttaaaatatattttaatac

SEQ ID NO: 124027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaaaatatattttaataca

SEQ ID NO: 124028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaatatattttaatacatt

SEQ ID NO: 124029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatatattttaatacattt

SEQ ID NO: 124030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatacatttgtggtcactg

SEQ ID NO: 124031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatacatttgtggtcactgc

SEQ ID NO: 124032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atacatttgtggtcactgcc

SEQ ID NO: 124033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtggtcactgcctttctaag

SEQ ID NO: 124034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggtcactgcctttctaaga

SEQ ID NO: 124035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctttctaagaatgcattac

SEQ ID NO: 124036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctaagaatgcattacaaat

SEQ ID NO: 124037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaagaatgcattacaaatt

SEQ ID NO: 124038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taagaatgcattacaaatta

SEQ ID NO: 124039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaatgcattacaaattact

SEQ ID NO: 124040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaattacttacctttaagt

SEQ ID NO: 124041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttacctttaagtacattat

SEQ ID NO: 124042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acctttaagtacattatcac

SEQ ID NO: 124043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctttaagtacattatcacc

SEQ ID NO: 124044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taagtacattatcacctaca

SEQ ID NO: 124045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagtacattatcacctacac

SEQ ID NO: 124046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtacattatcacctacact

SEQ ID NO: 124047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcacctacactgataaaaga

SEQ ID NO: 124048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cactgataaaagagagaata

SEQ ID NO: 124049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ataaaagagagaatacatct

SEQ ID NO: 124050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggatattttaattttacct

SEQ ID NO: 124051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattttacctcctcaatat

SEQ ID NO: 124052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattttacctcctcaatatc

SEQ ID NO: 124053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttacctcctcaatatca

SEQ ID NO: 124054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacctcctcaatatcatacc

SEQ ID NO: 124055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acctcctcaatatcatacca

SEQ ID NO: 124056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctcctcaatatcataccat

SEQ ID NO: 124057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcaatatcataccatgata

SEQ ID NO: 124058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatatcataccatgatattg

SEQ ID NO: 124059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaaaatactaaatgcttga

SEQ ID NO: 124060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatgcttgacaaataaaaaa

SEQ ID NO: 124061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacaaataaaaaatagaatc

SEQ ID NO: 124062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acaaataaaaaatagaatca

SEQ ID NO: 124063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtttccagggttaatatg

SEQ ID NO: 124064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccagggttaatatgctttat

SEQ ID NO: 124065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagggttaatatgctttatt

SEQ ID NO: 124066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatgctttattctggaaga

SEQ ID NO: 124067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattctggaagaatccatat

SEQ ID NO: 124068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attctggaagaatccatatt

SEQ ID NO: 124069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctggaagaatccatattt

SEQ ID NO: 124070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggaagaatccatatttttg

SEQ ID NO: 124071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaagaatccatatttttgta

SEQ ID NO: 124072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtattttattatttatat

SEQ ID NO: 124073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtattttattatttatata

SEQ ID NO: 124074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtattttattatttatataa

SEQ ID NO: 124075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattttattatttatataaa

SEQ ID NO: 124076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattatttatataaatatct

SEQ ID NO: 124077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attatttatataaatatcta

SEQ ID NO: 124078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatttatataaatatctac

SEQ ID NO: 124079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatataaatatctacgaa

SEQ ID NO: 124080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atataaatatctacgaaccc

SEQ ID NO: 124081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tataaatatctacgaacccc

SEQ ID NO: 124082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cgaaccccctactacttgat

SEQ ID NO: 124083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctacttgatgccaggcacta

SEQ ID NO: 124084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttgatgccaggcactattc

SEQ ID NO: 124085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatgccaggcactattctgg

SEQ ID NO: 124086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgccaggcactattctgga

SEQ ID NO: 124087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttctggaagctaagtcaaca

SEQ ID NO: 124088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggaagctaagtcaacaatg

SEQ ID NO: 124089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaagctaagtcaacaatgaa

SEQ ID NO: 124090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtcaacaatgaagacatag

SEQ ID NO: 124091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggttcccttggagtatttgg

SEQ ID NO: 124092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttggagtatttggtatgc

SEQ ID NO: 124093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggagtatttggtatgcaaat

SEQ ID NO: 124094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagtatttggtatgcaaatt

SEQ ID NO: 124095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtatgcaaattcacaaaat

SEQ ID NO: 124096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtatgcaaattcacaaaata

SEQ ID NO: 124097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaaaatacctgcatgctgt

SEQ ID NO: 124098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catgctgtaacaagcagtat

SEQ ID NO: 124099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taacaagcagtatgaaagaa

SEQ ID NO: 124100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caacatcaagaccaacacgg

SEQ ID NO: 124101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttttaacaagatgatcaaa

SEQ ID NO: 124102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaacaagatgatcaaaaat

SEQ ID NO: 124103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacaagatgatcaaaaatg

SEQ ID NO: 124104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacaagatgatcaaaaatga

SEQ ID NO: 124105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaagatgatcaaaaatgat

SEQ ID NO: 124106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccaaaacaaaaaaacctcg

SEQ ID NO: 124107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaaaacaaaaaaacctcga

SEQ ID NO: 124108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaaacaaaaaaacctcgag

SEQ ID NO: 124109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gagttgagatttaaagttta

SEQ ID NO: 124110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agatttaaagtttaagaagg

SEQ ID NO: 124111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagtttaagaaggagtaag

SEQ ID NO: 124112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtttaagaaggagtaagc

SEQ ID NO: 124113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagaaggagtaagcacgcat

SEQ ID NO: 124114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaaggagtaagcacgcata

SEQ ID NO: 124115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggcattgggaacagcattt

SEQ ID NO: 124116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaacagcatttgaaaaggc

SEQ ID NO: 124117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaaggccttaaagagtgc

SEQ ID NO: 124118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaggccttaaagagtgct

SEQ ID NO: 124119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaagagtgctattgtttcat

SEQ ID NO: 124120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagagtgctattgtttcatg

SEQ ID NO: 124121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgtttcatgtgttttagcc

SEQ ID NO: 124122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttcatgtgttttagccacg

SEQ ID NO: 124123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgtgttttagccacgacc

SEQ ID NO: 124124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtgttttagccacgacct

SEQ ID NO: 124125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagccacgacctgggcagga

SEQ ID NO: 124126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agccacgacctgggcaggag

SEQ ID NO: 124127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccacgacctgggcaggagc

SEQ ID NO: 124128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcaggagcaccttaatgag

SEQ ID NO: 124129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatgagaagagaataggttc

SEQ ID NO: 124130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgagaagagaataggttct

SEQ ID NO: 124131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggtgaggttggagagaagg

SEQ ID NO: 124132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtgaggttggagagaaggga

SEQ ID NO: 124133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagagaagggacagaacaga

SEQ ID NO: 124134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggaaaggcatttactgttg

SEQ ID NO: 124135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actgttgttgctaattggtc

SEQ ID NO: 124136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgttgttgctaattggtct

SEQ ID NO: 124137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgttgctaattggtctctg

SEQ ID NO: 124138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgctaattggtctctgtgt

SEQ ID NO: 124139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctaattggtctctgtgttgc

SEQ ID NO: 124140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attggtctctgtgttgccat

SEQ ID NO: 124141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtctctgtgttgccatgttt

SEQ ID NO: 124142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtgttgccatgtttatttc

SEQ ID NO: 124143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgttgccatgtttatttctt

SEQ ID NO: 124144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccatgtttatttcttcttct

SEQ ID NO: 124145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttcttcttctcctcttct

SEQ ID NO: 124146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcttcttctcctcttctt

SEQ ID NO: 124147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcttctcctcttcttctt

SEQ ID NO: 124148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcttctcctcttcttcttc

SEQ ID NO: 124149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttctcctcttcttcttcct

SEQ ID NO: 124150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctcctcttcttcttcctc

SEQ ID NO: 124151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcctcttcttcttcctctt

SEQ ID NO: 124152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctcttcttcttcctcttt

SEQ ID NO: 124153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcttcttcttcctcttttt

SEQ ID NO: 124154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcttcttcctctttttttt

SEQ ID NO: 124155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttcttcctctttttttttt

SEQ ID NO: 124156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcttcctcttttttttttt

SEQ ID NO: 124157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttcctcttttttttttttt

SEQ ID NO: 124158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcctctttttttttttttt

SEQ ID NO: 124159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctcttttttttttttttta

SEQ ID NO: 124160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctctttttttttttttttaa

SEQ ID NO: 124161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttttttttttttttaaatg

SEQ ID NO: 124162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttttttttttaaatgca

SEQ ID NO: 124163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttttttaaatgcag

SEQ ID NO: 124164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttaaatgcagt

SEQ ID NO: 124165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttttaaatgcagtt

SEQ ID NO: 124166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttaaatgcagttg

SEQ ID NO: 124167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttaaatgcagttgt

SEQ ID NO: 124168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttaaatgcagttgtg

SEQ ID NO: 124169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttaaatgcagttgtga

SEQ ID NO: 124170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttaaatgcagttgtgag

SEQ ID NO: 124171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaaatgcagttgtgagc

SEQ ID NO: 124172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaatgcagttgtgagcc

SEQ ID NO: 124173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaatgcagttgtgagcca

SEQ ID NO: 124174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaatgcagttgtgagccaa

SEQ ID NO: 124175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatgcagttgtgagccaat

SEQ ID NO: 124176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgcagttgtgagccaatg

SEQ ID NO: 124177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgagccaatgtttgttaggg

SEQ ID NO: 124178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttaggggagacaggatggt

SEQ ID NO: 124179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaggggagacaggatggta

SEQ ID NO: 124180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggggagacaggatggtattg

SEQ ID NO: 124181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttgtatagagaatgaatt

SEQ ID NO: 124182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtatagagaatgaattgca

SEQ ID NO: 124183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatagagaatgaattgcag

SEQ ID NO: 124184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatagagaatgaattgcagg

SEQ ID NO: 124185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caggggagaaaattacagaa

SEQ ID NO: 124186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagaagtggagagattgata

SEQ ID NO: 124187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atatggaggctgtggcagga

SEQ ID NO: 124188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggcaggattccaagtaaat

SEQ ID NO: 124189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caagtaaattatgatgatga

SEQ ID NO: 124190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgatgatgacctgaactaat

SEQ ID NO: 124191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aactaatttggtggccgtgt

SEQ ID NO: 124192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttggtggccgtgtagata

SEQ ID NO: 124193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtggccgtgtagatacaga

SEQ ID NO: 124194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtggccgtgtagatacagaa

SEQ ID NO: 124195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agacgtatgatgaaatagaa

SEQ ID NO: 124196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggagataagattgatagat

SEQ ID NO: 124197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggagataagattgatagatc

SEQ ID NO: 124198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atagatctacttacaggctg

SEQ ID NO: 124199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttacaggctggaaagggct

SEQ ID NO: 124200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acaggctggaaagggctgaa

SEQ ID NO: 124201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caggctggaaagggctgaaa

SEQ ID NO: 124202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaagggctgaaatggagta

SEQ ID NO: 124203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaatggagtaataaggaaga

SEQ ID NO: 124204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatacttggatggtgaagg

SEQ ID NO: 124205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatacttggatggtgaaggc

SEQ ID NO: 124206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggatggtgaaggcatttatt

SEQ ID NO: 124207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gatggtgaaggcatttattc

SEQ ID NO: 124208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attcagataatgaagatggg

SEQ ID NO: 124209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcagataatgaagatggga

SEQ ID NO: 124210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agataatgaagatgggagga

SEQ ID NO: 124211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agacagagttttagggaaag

SEQ ID NO: 124212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagggaaagtcataaattat

SEQ ID NO: 124213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agggaaagtcataaattatt

SEQ ID NO: 124214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gggaaagtcataaattatta

SEQ ID NO: 124215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatcattatgacatctaga

SEQ ID NO: 124216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcattatgacatctagaatg

SEQ ID NO: 124217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgacatctagaatgttccat

SEQ ID NO: 124218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaatgttccatttacatcaa

SEQ ID NO: 124219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catttacatcaataaacttt

SEQ ID NO: 124220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatcaataaactttaagct

SEQ ID NO: 124221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catcaataaactttaagctc

SEQ ID NO: 124222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taagctcttttacaagatca

SEQ ID NO: 124223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagctcttttacaagatcat

SEQ ID NO: 124224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agctcttttacaagatcatg

SEQ ID NO: 124225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttacaagatcatgacttg

SEQ ID NO: 124226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttacaagatcatgacttgtc

SEQ ID NO: 124227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacaagatcatgacttgtct

SEQ ID NO: 124228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaagatcatgacttgtctt

SEQ ID NO: 124229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caagatcatgacttgtctta

SEQ ID NO: 124230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtcttagaaaagtaccatat

SEQ ID NO: 124231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttagaaaagtaccatata

SEQ ID NO: 124232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaaaagtaccatataaatc

SEQ ID NO: 124233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaaagtaccatataaatcc

SEQ ID NO: 124234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctagcacttcacactctttt

SEQ ID NO: 124235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagcacttcacactcttttg

SEQ ID NO: 124236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcacttcacactcttttgca

SEQ ID NO: 124237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacactcttttgcataacta

SEQ ID NO: 124238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acactcttttgcataactaa

SEQ ID NO: 124239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttgcataactaataggaa

SEQ ID NO: 124240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgcataactaataggaata

SEQ ID NO: 124241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcataactaataggaatag

SEQ ID NO: 124242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcataactaataggaataga

SEQ ID NO: 124243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cataactaataggaatagaa

SEQ ID NO: 124244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ataggaatagaaattggata

SEQ ID NO: 124245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gataaaaaatagattttatt

SEQ ID NO: 124246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattattcatgtaaaatgaa

SEQ ID NO: 124247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attattcatgtaaaatgaaa

SEQ ID NO: 124248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattcatgtaaaatgaaaa

SEQ ID NO: 124249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcatgtaaaatgaaaaatt

SEQ ID NO: 124250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtaaaatgaaaaattcta

SEQ ID NO: 124251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacttttttccttgccacag

SEQ ID NO: 124252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttttttccttgccacagag

SEQ ID NO: 124253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttccttgccacagagaaa

SEQ ID NO: 124254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttccttgccacagagaaag

SEQ ID NO: 124255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccttgccacagagaaagt

SEQ ID NO: 124256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccttgccacagagaaagtg

SEQ ID NO: 124257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttgccacagagaaagtgg

SEQ ID NO: 124258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttgccacagagaaagtggg

SEQ ID NO: 124259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gccacagagaaagtgggttg

SEQ ID NO: 124260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccacagagaaagtgggttga

SEQ ID NO: 124261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attatattaaataaatagaa

SEQ ID NO: 124262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattaaataaatagaaccct

SEQ ID NO: 124263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataaatagaaccctactga

SEQ ID NO: 124264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgattgctcttctgaattt

SEQ ID NO: 124265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attgctcttctgaatttatt

SEQ ID NO: 124266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcttctgaatttatttatt

SEQ ID NO: 124267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttctgaatttatttatttgt

SEQ ID NO: 124268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgaatttatttatttgttt

SEQ ID NO: 124269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaatttatttatttgttta

SEQ ID NO: 124270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatttatttatttgtttatc

SEQ ID NO: 124271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttgtttatctattt

SEQ ID NO: 124272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttgtttatctatttt

SEQ ID NO: 124273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttgtttatctattttgct

SEQ ID NO: 124274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgtttatctattttgctt

SEQ ID NO: 124275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttatctattttgcttctg

SEQ ID NO: 124276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttatctattttgcttctga

SEQ ID NO: 124277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctattttgcttctgaaac

SEQ ID NO: 124278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctattttgcttctgaaact

SEQ ID NO: 124279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttgcttctgaaactcagc

SEQ ID NO: 124280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcttctgaaactcagcaca

SEQ ID NO: 124281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttctgaaactcagcacag

SEQ ID NO: 124282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttctgaaactcagcacagc

SEQ ID NO: 124283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgaaactcagcacagcaac

SEQ ID NO: 124284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaaactcagcacagcaaca

SEQ ID NO: 124285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaactcagcacagcaacagg

SEQ ID NO: 124286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcacagcaacaggtagtaa

SEQ ID NO: 124287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccacagaagggctcccatga

SEQ ID NO: 124288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccatgattatatgcaggccc

SEQ ID NO: 124289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatgcaggccctaggggaaa

SEQ ID NO: 124290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggggaaaggaggcccaagat

SEQ ID NO: 124291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttggcagagagccagacctg

SEQ ID NO: 124292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggcagagagccagacctga

SEQ ID NO: 124293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcagagagccagacctgac

SEQ ID NO: 124294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcagagagccagacctgact

SEQ ID NO: 124295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actcatctttcttctgtaga

SEQ ID NO: 124296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atctttcttctgtagaagca

SEQ ID NO: 124297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttctgtagaagcatcagg

SEQ ID NO: 124298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttctgtagaagcatcaggt

SEQ ID NO: 124299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctgtagaagcatcaggta

SEQ ID NO: 124300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgtagaagcatcaggtact

SEQ ID NO: 124301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtagaagcatcaggtactc

SEQ ID NO: 124302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagaagcatcaggtactctg

SEQ ID NO: 124303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtgagcctagccctgcacc

SEQ ID NO: 124304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgagcctagccctgcaccat

SEQ ID NO: 124305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gccctgcaccataggaatca

SEQ ID NO: 124306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caccataggaatcaaggcat

SEQ ID NO: 124307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaaaacacatcactgagtc

SEQ ID NO: 124308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtcccacaactgcacagtg

SEQ ID NO: 124309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cacagtggcttacttaagga

SEQ ID NO: 124310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acttaaggaaacctcctttt

SEQ ID NO: 124311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttaaggaaacctcctttta

SEQ ID NO: 124312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaggaaacctccttttaaac

SEQ ID NO: 124313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggaaacctccttttaaacc

SEQ ID NO: 124314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttttaaacctctacaaaat

SEQ ID NO: 124315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaacctctacaaaatttt

SEQ ID NO: 124316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaacctctacaaaatttta

SEQ ID NO: 124317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaacctctacaaaattttaa

SEQ ID NO: 124318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacctctacaaaattttaaa

SEQ ID NO: 124319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tacaaaattttaaaaaactt

SEQ ID NO: 124320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaaattttaaaaaacttgt

SEQ ID NO: 124321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaaacttgtcttaagcc

SEQ ID NO: 124322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaacttgtcttaagcca

SEQ ID NO: 124323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaacttgtcttaagccaa

SEQ ID NO: 124324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtcttaagccaaactatcag

SEQ ID NO: 124325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttaagccaaactatcagt

SEQ ID NO: 124326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagccaaactatcagttgcc

SEQ ID NO: 124327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agccaaactatcagttgcct

SEQ ID NO: 124328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcagttgcctaaatagaggg

SEQ ID NO: 124329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctaaatagagggcacattc

SEQ ID NO: 124330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatagagggcacattcttct

SEQ ID NO: 124331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctttacatcaaataccat

SEQ ID NO: 124332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttacatcaaataccatat

SEQ ID NO: 124333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttacatcaaataccatatt

SEQ ID NO: 124334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacatcaaataccatattct

SEQ ID NO: 124335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatcaaataccatattctg

SEQ ID NO: 124336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catcaaataccatattctgt

SEQ ID NO: 124337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtctagagttttgttgttg

SEQ ID NO: 124338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctagagttttgttgttgat

SEQ ID NO: 124339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gagttttgttgttgataagc

SEQ ID NO: 124340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttgttgataagctagtct

SEQ ID NO: 124341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttgttgataagctagtcta

SEQ ID NO: 124342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgttgataagctagtctaa

SEQ ID NO: 124343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgataagctagtctaacaa

SEQ ID NO: 124344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataagctagtctaacaatca

SEQ ID NO: 124345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtctaacaatcatgaaaatt

SEQ ID NO: 124346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acaatcatgaaaatttgcga

SEQ ID NO: 124347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcgacacagggatcagataa

SEQ ID NO: 124348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cgacacagggatcagataag

SEQ ID NO: 124349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctttcaaactaatcaataa

SEQ ID NO: 124350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaaactaatcaataatttt

SEQ ID NO: 124351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaactaatcaataattttt

SEQ ID NO: 124352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaactaatcaataattttta

SEQ ID NO: 124353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atcaataatttttaaaaaat

SEQ ID NO: 124354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaaaatctcaccataat

SEQ ID NO: 124355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaaatctcaccataatt

SEQ ID NO: 124356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaatctcaccataatta

SEQ ID NO: 124357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaatctcaccataattat

SEQ ID NO: 124358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
accataattataagaaaaaa

SEQ ID NO: 124359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taagaaaaaattataaactt

SEQ ID NO: 124360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaacttttttaaatagtgg

SEQ ID NO: 124361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttaaatagtggaaaaaat

SEQ ID NO: 124362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaatagtggaaaaaatc

SEQ ID NO: 124363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaatagtggaaaaaatct

SEQ ID NO: 124364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaatagtggaaaaaatctg

SEQ ID NO: 124365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatagtggaaaaaatctga

SEQ ID NO: 124366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatagtggaaaaaatctgaa

SEQ ID NO: 124367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagaatttgcaataaaatga

SEQ ID NO: 124368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaataaaatgaacagttta

SEQ ID NO: 124369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caataaaatgaacagtttaa

SEQ ID NO: 124370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aataattggatttggtttgc

SEQ ID NO: 124371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataattggatttggtttgca

SEQ ID NO: 124372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gatttggtttgcagtttata

SEQ ID NO: 124373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtttgcagtttatataaaa

SEQ ID NO: 124374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtttgcagtttatataaaat

SEQ ID NO: 124375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcagtttatataaaataggt

SEQ ID NO: 124376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagtttatataaaataggtt

SEQ ID NO: 124377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atataaaataggtttatatt

SEQ ID NO: 124378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tataaaataggtttatattg

SEQ ID NO: 124379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atattgatgttaaagcaaaa

SEQ ID NO: 124380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattgatgttaaagcaaaaa

SEQ ID NO: 124381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgttaaagcaaaaattata

SEQ ID NO: 124382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagcaaaaattataaaatat

SEQ ID NO: 124383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaaatatatttaaataaca

SEQ ID NO: 124384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaataacaaggaaagaaaga

SEQ ID NO: 124385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataacaaggaaagaaagag

SEQ ID NO: 124386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatcttgtctacagggaaga

SEQ ID NO: 124387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttgtctacagggaagaa

SEQ ID NO: 124388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttgtctacagggaagaag

SEQ ID NO: 124389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtctacagggaagaagaaat

SEQ ID NO: 124390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctacagggaagaagaaata

SEQ ID NO: 124391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagggaagaagaaatagaaa

SEQ ID NO: 124392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaaaagaactgaacttcc

SEQ ID NO: 124393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaaaagaactgaacttccc

SEQ ID NO: 124394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaagaactgaacttcccaa

SEQ ID NO: 124395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacttcccaacactgacttc

SEQ ID NO: 124396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccaacactgacttcctatt

SEQ ID NO: 124397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaacactgacttcctattc

SEQ ID NO: 124398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acttcctattcagtaactga

SEQ ID NO: 124399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctattcagtaactgacaag

SEQ ID NO: 124400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctattcagtaactgacaagc

SEQ ID NO: 124401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttcagtaactgacaagctat

SEQ ID NO: 124402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtaactgacaagctatcac

SEQ ID NO: 124403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acaagctatcacttccttga

SEQ ID NO: 124404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcacttccttgaaagcttac

SEQ ID NO: 124405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttgaaagcttactttgat

SEQ ID NO: 124406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttgaaagcttactttgatt

SEQ ID NO: 124407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaagcttactttgatttgg

SEQ ID NO: 124408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaagcttactttgatttggc

SEQ ID NO: 124409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actttgatttggcttttatc

SEQ ID NO: 124410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttgatttggcttttatct

SEQ ID NO: 124411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgatttggcttttatcttac

SEQ ID NO: 124412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatttggcttttatcttact

SEQ ID NO: 124413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atttggcttttatcttactg

SEQ ID NO: 124414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcttttatcttactgacac

SEQ ID NO: 124415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcttttatcttactgacact

SEQ ID NO: 124416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatcttactgacactagct

SEQ ID NO: 124417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcttactgacactagctt

SEQ ID NO: 124418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttactgacactagcttc

SEQ ID NO: 124419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttactgacactagcttct

SEQ ID NO: 124420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actgacactagcttcttaaa

SEQ ID NO: 124421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgacactagcttcttaaaa

SEQ ID NO: 124422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acactagcttcttaaaaacc

SEQ ID NO: 124423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcttcttaaaaaccccccta

SEQ ID NO: 124424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttaaaaacccccctaagtt

SEQ ID NO: 124425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaaaaacccccctaagttt

SEQ ID NO: 124426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaaacccccctaagtttct

SEQ ID NO: 124427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaacccccctaagtttctc

SEQ ID NO: 124428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtttctcatgtaaattgct

SEQ ID NO: 124429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcatgtaaattgctcttaa

SEQ ID NO: 124430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcatgtaaattgctcttaac

SEQ ID NO: 124431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgtaaattgctcttaacat

SEQ ID NO: 124432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcttaacatcagagtagat

SEQ ID NO: 124433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaacatcagagtagatata

SEQ ID NO: 124434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacatcagagtagatataat

SEQ ID NO: 124435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatcagagtagatataatc

SEQ ID NO: 124436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgaacgctccaacttaaaaa

SEQ ID NO: 124437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caacttaaaaaaaaaaaact

SEQ ID NO: 124438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaaaaaaaaaactaaaata

SEQ ID NO: 124439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaaaaaaactaaaataa

SEQ ID NO: 124440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaataatgagtgaaatgttt

SEQ ID NO: 124441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actataatcacaaaaactgg

SEQ ID NO: 124442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctataatcacaaaaactggc

SEQ ID NO: 124443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatcacaaaaactggcatt

SEQ ID NO: 124444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcattaatgtttctagtttc

SEQ ID NO: 124445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgtttctagtttcttgttc

SEQ ID NO: 124446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctagtttcttgttctgattt

SEQ ID NO: 124447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagtttcttgttctgatttt

SEQ ID NO: 124448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtttcttgttctgatttttg

SEQ ID NO: 124449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgttctgatttttgtctt

SEQ ID NO: 124450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgttctgatttttgtcttg

SEQ ID NO: 124451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttctgatttttgtcttgaa

SEQ ID NO: 124452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttctgatttttgtcttgaat

SEQ ID NO: 124453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgatttttgtcttgaatata

SEQ ID NO: 124454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atttttgtcttgaatataag

SEQ ID NO: 124455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtcttgaatataaggcac

SEQ ID NO: 124456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtcttgaatataaggcacg

SEQ ID NO: 124457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcttgaatataaggcacga

SEQ ID NO: 124458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttgaatataaggcacgaa

SEQ ID NO: 124459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaatataaggcacgaaaata

SEQ ID NO: 124460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatataaggcacgaaaatat

SEQ ID NO: 124461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcctaaaagtaaatgagt

SEQ ID NO: 124462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcctaaaagtaaatgagtt

SEQ ID NO: 124463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctaaaagtaaatgagttt

SEQ ID NO: 124464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctaaaagtaaatgagtttc

SEQ ID NO: 124465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctaaaagtaaatgagtttcc

SEQ ID NO: 124466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaagtaaatgagtttcccaa

SEQ ID NO: 124467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccaagttgaattcgataaa

SEQ ID NO: 124468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaagttgaattcgataaaa

SEQ ID NO: 124469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattcgataaaaagttaaaa

SEQ ID NO: 124470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gataaaaagttaaaaggatt

SEQ ID NO: 124471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaggattctgcatcttttc

SEQ ID NO: 124472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcatcttttctgaatttca

SEQ ID NO: 124473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catcttttctgaatttcact

SEQ ID NO: 124474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctgaatttcactataaag

SEQ ID NO: 124475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgaatttcactataaagt

SEQ ID NO: 124476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgaatttcactataaagtg

SEQ ID NO: 124477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaatttcactataaagtgc

SEQ ID NO: 124478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatttcactataaagtgctt

SEQ ID NO: 124479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cactataaagtgcttattcg

SEQ ID NO: 124480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actataaagtgcttattcga

SEQ ID NO: 124481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaagtgcttattcgaaaaa

SEQ ID NO: 124482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attcgaaaaaataaataaat

SEQ ID NO: 124483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcgaaaaaataaataaata

SEQ ID NO: 124484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gaaaaaataaataaataatc

SEQ ID NO: 124485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cgctgagaaataggggcaga

SEQ ID NO: 124486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaaataggggcagagctgt

SEQ ID NO: 124487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcctgtcaattatttgtgtt

SEQ ID NO: 124488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcaattatttgtgtttgtgt

SEQ ID NO: 124489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgtgtttgtgtgctctta

SEQ ID NO: 124490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgtttgtgtgctcttaagg

SEQ ID NO: 124491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtttgtgtgctcttaaggg

SEQ ID NO: 124492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgtgctcttaaggggtgcg

SEQ ID NO: 124493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtgctcttaaggggtgcgg

SEQ ID NO: 124494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaaggggtgcggggttctt

SEQ ID NO: 124495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaggggtgcggggttctttt

SEQ ID NO: 124496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggggtgcggggttcttttc

SEQ ID NO: 124497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttctgtccccacaggttg

SEQ ID NO: 124498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctgtccccacaggttgta

SEQ ID NO: 124499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgtccccacaggttgtat

SEQ ID NO: 124500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtccccacaggttgtatc

SEQ ID NO: 124501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtccccacaggttgtatct

SEQ ID NO: 124502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tccccacaggttgtatctgc

SEQ ID NO: 124503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatctgctaagctggttctg

SEQ ID NO: 124504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctaagctggttctgcacgct

SEQ ID NO: 124505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agctggttctgcacgctcag

SEQ ID NO: 124506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttctgcacgctcagctttg

SEQ ID NO: 124507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcacgctcagctttgcaga

SEQ ID NO: 124508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cacgctcagctttgcagatg

SEQ ID NO: 124509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agctttgcagatgggaaata

SEQ ID NO: 124510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcagatgggaaatacagca

SEQ ID NO: 124511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcagatgggaaatacagcac

SEQ ID NO: 124512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagatgggaaatacagcaca

SEQ ID NO: 124513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttgctcgtaaaaaatgtga

SEQ ID NO: 124514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgctcgtaaaaaatgtgag

SEQ ID NO: 124515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctcgtaaaaaatgtgagc

SEQ ID NO: 124516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctcgtaaaaaatgtgagct

SEQ ID NO: 124517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcgtaaaaaatgtgagctg

SEQ ID NO: 124518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gtaaaaaatgtgagctgccc

SEQ ID NO: 124519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccccttgaattgaagtccat

SEQ ID NO: 124520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaattgaagtccatctaaca

SEQ ID NO: 124521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattgaagtccatctaacaa

SEQ ID NO: 124522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagtccatctaacaactctg

SEQ ID NO: 124523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acaactctgctagcgtaaac

SEQ ID NO: 124524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgctagcgtaaacagaaata

SEQ ID NO: 124525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctagcgtaaacagaaataaa

SEQ ID NO: 124526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcgtaaacagaaataaaaga

SEQ ID NO: 124527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctacccttcctttccacagt

SEQ ID NO: 124528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cccttcctttccacagtttc

SEQ ID NO: 124529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctttccacagtttcagaac

SEQ ID NO: 124530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttccacagtttcagaacc

SEQ ID NO: 124531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccacagtttcagaacctgg

SEQ ID NO: 124532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccacagtttcagaacctggc

SEQ ID NO: 124533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacagtttcagaacctggca

SEQ ID NO: 124534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagaacctggcagcaaaccc

SEQ ID NO: 124535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaacctggcagcaaaccca

SEQ ID NO: 124536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcagcaaacccacagagtca

SEQ ID NO: 124537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cccagctatcgaaataacta

SEQ ID NO: 124538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcgaaataactacgcttcca

SEQ ID NO: 124539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cgcttccagcccttcttcct

SEQ ID NO: 124540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccagcccttcttcctcccat

SEQ ID NO: 124541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagcccttcttcctcccatt

SEQ ID NO: 124542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttcctcccattgctggaac

SEQ ID NO: 124543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcctcccattgctggaacc

SEQ ID NO: 124544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctcccattgctggaaccac

SEQ ID NO: 124545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcccattgctggaaccacc

SEQ ID NO: 124546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccattgctggaaccacccgg

SEQ ID NO: 124547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctggaaccacccggtcaagc

SEQ ID NO: 124548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaccacccggtcaagcttc

SEQ ID NO: 124549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcccctctcttctttccag

SEQ ID NO: 124550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcccctctcttctttccagg

SEQ ID NO: 124551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccctctcttctttccaggtg

SEQ ID NO: 124552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcttctttccaggtggcgta

SEQ ID NO: 124553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttctttccaggtggcgtaat

SEQ ID NO: 124554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttccaggtggcgtaatac

SEQ ID NO: 124555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttccaggtggcgtaataca

SEQ ID NO: 124556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccaggtggcgtaatacagg

SEQ ID NO: 124557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaggtggcgtaatacaggg

SEQ ID NO: 124558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caggtggcgtaatacagggt

SEQ ID NO: 124559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagaaccgagatgtgaaaat

SEQ ID NO: 124560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggcgagcacgggcgaaaga

SEQ ID NO: 124561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcctcccctccccacagaa

SEQ ID NO: 124562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctcccctccccacagaag

SEQ ID NO: 124563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcccctccccacagaagca

SEQ ID NO: 124564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccctccccacagaagcagca

SEQ ID NO: 124565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cccacagaagcagcaaaaga

SEQ ID NO: 124566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acttgcaacctagcccgccg

SEQ ID NO: 124567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttgcaacctagcccgccga

SEQ ID NO: 124568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcaacctagcccgccgatca

SEQ ID NO: 124569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caacctagcccgccgatcat

SEQ ID NO: 124570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcccgccgatcatccccacc

SEQ ID NO: 124571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagaatctggctccaggaga

SEQ ID NO: 124572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctccaggagagggcgcggg

SEQ ID NO: 124573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caggagagggcgcgggcctc

SEQ ID NO: 124574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tccttccccggcgctctctc

SEQ ID NO: 124575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttccccggcgctctctcag

SEQ ID NO: 124576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccccggcgctctctcagggc

SEQ ID NO: 124577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccggcgctctctcagggct

SEQ ID NO: 124578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctcagggctgcttcttttt

SEQ ID NO: 124579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcagggctgcttctttttct

SEQ ID NO: 124580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agggctgcttctttttctct

SEQ ID NO: 124581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttctttttctctgggctcc

SEQ ID NO: 124582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttttctctgggctcctgt

SEQ ID NO: 124583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttctctgggctcctgtt

SEQ ID NO: 124584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttctctgggctcctgttgc

SEQ ID NO: 124585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctctgggctcctgttgct

SEQ ID NO: 124586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctctgggctcctgttgctc

SEQ ID NO: 124587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctgggctcctgttgctca

SEQ ID NO: 124588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgggctcctgttgctcag

SEQ ID NO: 124589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgggctcctgttgctcaggg

SEQ ID NO: 124590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggctcctgttgctcagggga

SEQ ID NO: 124591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgttgctcaggggacgcct

SEQ ID NO: 124592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgctcaggggacgcctgcc

SEQ ID NO: 124593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcaggggacgcctgccgct

SEQ ID NO: 124594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggggacgcctgccgctagc

SEQ ID NO: 124595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccgctagcagccactggcac

SEQ ID NO: 124596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcagccactggcacccaggc

SEQ ID NO: 124597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcacccaggctagcccagcc

SEQ ID NO: 124598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcccagcctcagccgagctg

SEQ ID NO: 124599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agccgagctggcggaattgg

SEQ ID NO: 124600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcggaattggaaagccgaca

SEQ ID NO: 124601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaagccgacagccgccgct

SEQ ID NO: 124602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagcgctggcgaccgcctgc

SEQ ID NO: 124603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcgaccgcctgcaagcagac

SEQ ID NO: 124604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caagcagactgcgcccctcc

SEQ ID NO: 124605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cgcccctcctgccagggcgc

SEQ ID NO: 124606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgccagggcgcgcccgtgg

SEQ ID NO: 124607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccagggcgcgcccgtggagg

SEQ ID NO: 124608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cccgagggcagctgcgccgc

SEQ ID NO: 124609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cgccgctttgcctcctccac

SEQ ID NO: 124610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcctcctccactcctccca

SEQ ID NO: 124611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcctcctccactcctcccag

SEQ ID NO: 124612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctcctccactcctcccagc

SEQ ID NO: 124613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctccactcctcccagcgcgc

SEQ ID NO: 124614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cactcctcccagcgcgcccg

SEQ ID NO: 124615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcccagcgcgcccgggtcc

SEQ ID NO: 124616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccagcgcgcccgggtcccca

SEQ ID NO: 124617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctccctccctccctccctc

SEQ ID NO: 124618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctccctccctccctccctct

SEQ ID NO: 124619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctccctccctccctctctc

SEQ ID NO: 124620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctccctccctctctccact

SEQ ID NO: 124621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctccctctctccactcctg

SEQ ID NO: 124622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctctctccactcctgcggg

SEQ ID NO: 124623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctccactcctgcgggcggc

SEQ ID NO: 124624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tccactcctgcgggcggcgc

SEQ ID NO: 124625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cactcctgcgggcggcgcag

SEQ ID NO: 124626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgcgggcggcgcagggcgg

SEQ ID NO: 124627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cgggcggcgcagggcgggga

SEQ ID NO: 124628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggggcgcggtggtggcgacg

SEQ ID NO: 124629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagcctctgcaccatgcgct

SEQ ID NO: 124630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcaccatgcgctaatagaa

SEQ ID NO: 124631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caccatgcgctaatagaagg

SEQ ID NO: 124632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atagaaggcggaggaggggg

SEQ ID NO: 124633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cacgacctgccatccacggc

SEQ ID NO: 124634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccatccacggccacccattg

SEQ ID NO: 124635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggtggggcgtgtgtgtgttt

SEQ ID NO: 124636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagtgtgtgtgtgtgtgtgt

SEQ ID NO: 124637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtgtgtgtgtgtgtgtgtc

SEQ ID NO: 124638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cccttatctcacccccgccc

SEQ ID NO: 124639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttatctcacccccgcccc

SEQ ID NO: 124640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atctcacccccgcccccatc

SEQ ID NO: 124641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctcacccccgcccccatca

SEQ ID NO: 124642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acccccgcccccatcatccc

SEQ ID NO: 124643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcctcccttcctgctcagca

SEQ ID NO: 124644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctcccttcctgctcagcag

SEQ ID NO: 124645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcccttcctgctcagcaga

SEQ ID NO: 124646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccttcctgctcagcagaatc

SEQ ID NO: 124647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctgctcagcagaatcggct

SEQ ID NO: 124648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgctcagcagaatcggcta

SEQ ID NO: 124649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctcagcagaatcggctaatg

SEQ ID NO: 124650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcagaatcggctaatgttt

SEQ ID NO: 124651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgtttccgagaagtcactt

SEQ ID NO: 124652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccgagaagtcactttgtgtg

SEQ ID NO: 124653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cgagaagtcactttgtgtgg

SEQ ID NO: 124654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtgtggcttggtggggagc

SEQ ID NO: 124655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgtggcttggtggggagct

SEQ ID NO: 124656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtggcttggtggggagctg

SEQ ID NO: 124657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtggggagctggagaaaaa

SEQ ID NO: 124658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtggggagctggagaaaaac

SEQ ID NO: 124659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagaaaaactccggagcaga

SEQ ID NO: 124660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cggagcagaggaggtgggga

SEQ ID NO: 124661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtctggggcagtggctggg

SEQ ID NO: 124662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gggcagtggctggggagcca

SEQ ID NO: 124663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gggagccagacaacaccgcc

SEQ ID NO: 124664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cccgaccttgggctctgaag

SEQ ID NO: 124665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gggctctgaagagtctaggc

SEQ ID NO: 124666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggctctgaagagtctaggct

SEQ ID NO: 124667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgaagagtctaggctgggaa

SEQ ID NO: 124668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagagtctaggctgggaatt

SEQ ID NO: 124669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggctgggaattggtttcttc

SEQ ID NO: 124670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaattggtttcttccgtag

SEQ ID NO: 124671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtttcttccgtagggctttg

SEQ ID NO: 124672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttccgtagggctttgctca

SEQ ID NO: 124673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttccgtagggctttgctcac

SEQ ID NO: 124674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccgtagggctttgctcacaa

SEQ ID NO: 124675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cgtagggctttgctcacaac

SEQ ID NO: 124676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgctcacaaccgcgagtggg

SEQ ID NO: 124677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctcacaaccgcgagtgggg

SEQ ID NO: 124678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcacaaccgcgagtggggc

SEQ ID NO: 124679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acaaccgcgagtggggcggt

SEQ ID NO: 124680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagaccggtatctaggctat

SEQ ID NO: 124681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggctatgttttctgttttct

SEQ ID NO: 124682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgttttctgttttctttata

SEQ ID NO: 124683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgttttctttatatatat

SEQ ID NO: 124684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgttttctttatatatatg

SEQ ID NO: 124685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttttctttatatatatgt

SEQ ID NO: 124686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttctttatatatatgtat

SEQ ID NO: 124687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttatatatatgtatata

SEQ ID NO: 124688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttatatatatgtatatat

SEQ ID NO: 124689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttatatatatgtatatata

SEQ ID NO: 124690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatatatatgtatatataaa

SEQ ID NO: 124691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatatatgtatatataaaa

SEQ ID NO: 124692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatatatgtatatataaaat

SEQ ID NO: 124693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattgcagcgtcttccaggc

SEQ ID NO: 124694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagcgtcttccaggcaagca

SEQ ID NO: 124695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaggcaagcaaataataca

SEQ ID NO: 124696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caggcaagcaaataatacat

SEQ ID NO: 124697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttcgaagatgcagtgaa

SEQ ID NO: 124698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcgaagatgcagtgaag

SEQ ID NO: 124699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcgaagatgcagtgaaga

SEQ ID NO: 124700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcgaagatgcagtgaagaat

SEQ ID NO: 124701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgaagatgcagtgaagaatc

SEQ ID NO: 124702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gaagatgcagtgaagaatca

SEQ ID NO: 124703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtggggaaagaaacgtggg

SEQ ID NO: 124704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cttttccagacctgggaccc

SEQ ID NO: 124705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttccagacctgggacccgat

SEQ ID NO: 124706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccagacctgggacccgatt

SEQ ID NO: 124707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccagacctgggacccgatta

SEQ ID NO: 124708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagacctgggacccgattat

SEQ ID NO: 124709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggacccgattatctgaatat

SEQ ID NO: 124710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgaatatgccatcagtca

SEQ ID NO: 124711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatatgccatcagtcatatg

SEQ ID NO: 124712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaatttcagagctggtagg

SEQ ID NO: 124713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatttcagagctggtaggag

SEQ ID NO: 124714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagagctggtaggagcgact

SEQ ID NO: 124715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agagctggtaggagcgactg

SEQ ID NO: 124716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtaggagcgactgtgaaaat

SEQ ID NO: 124717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgaaaataaattttttaaaa

SEQ ID NO: 124718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaaaattcattttgtgt

SEQ ID NO: 124719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaaattcattttgtgtg

SEQ ID NO: 124720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaattcattttgtgtgg

SEQ ID NO: 124721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaattcattttgtgtgga

SEQ ID NO: 124722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaattcattttgtgtggag

SEQ ID NO: 124723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attttgtgtggagtgtgtgc

SEQ ID NO: 124724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgtggagtgtgtgcgtgc

SEQ ID NO: 124725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgtggagtgtgtgcgtgcg

SEQ ID NO: 124726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtggagtgtgtgcgtgcgc

SEQ ID NO: 124727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcctacagcagcctgggagg

SEQ ID NO: 124728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctacagcagcctgggagga

SEQ ID NO: 124729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctacagcagcctgggaggaa

SEQ ID NO: 124730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagcagcctgggaggaagaa

SEQ ID NO: 124731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaggaagaacaatggaaac

SEQ ID NO: 124732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattatctttctcaaagaga

SEQ ID NO: 124733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctttctcaaagagaaacag

SEQ ID NO: 124734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctcaaagagaaacaggaaa

SEQ ID NO: 124735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcaaagagaaacaggaaat

SEQ ID NO: 124736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaaagagaaacaggaaatt

SEQ ID NO: 124737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaagagaaacaggaaatttc

SEQ ID NO: 124738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaccaagggaagaaatcaa

SEQ ID NO: 124739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caccaagggaagaaatcaaa

SEQ ID NO: 124740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaaaagggcagaccacttt

SEQ ID NO: 124741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaagggcagaccactttgc

SEQ ID NO: 124742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcaggataaacactagtga

SEQ ID NO: 124743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaggataaacactagtgac

SEQ ID NO: 124744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caggataaacactagtgacg

SEQ ID NO: 124745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtgacgggcacttttattat

SEQ ID NO: 124746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttattatttgcttccacacc

SEQ ID NO: 124747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattatttgcttccacacct

SEQ ID NO: 124748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attatttgcttccacacctt

SEQ ID NO: 124749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatttgcttccacaccttc

SEQ ID NO: 124750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgcttccacaccttctat

SEQ ID NO: 124751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttccacaccttctatcat

SEQ ID NO: 124752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttccacaccttctatcatg

SEQ ID NO: 124753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccacaccttctatcatggaa

SEQ ID NO: 124754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacaccttctatcatggaaa

SEQ ID NO: 124755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctatcatggaaatgatgctt

SEQ ID NO: 124756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatcatggaaatgatgctta

SEQ ID NO: 124757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcatggaaatgatgcttaga

SEQ ID NO: 124758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agagataaccggaaggaaat

SEQ ID NO: 124759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagataaccggaaggaaatc

SEQ ID NO: 124760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttttccctgctgctttctt

SEQ ID NO: 124761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttccctgctgctttctttgc

SEQ ID NO: 124762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccctgctgctttctttgct

SEQ ID NO: 124763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctgctgctttctttgctt

SEQ ID NO: 124764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctgctgctttctttgcttc

SEQ ID NO: 124765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctgctttctttgcttctgag

SEQ ID NO: 124766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctttctttgcttctgagatt

SEQ ID NO: 124767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttgcttctgagatttgt

SEQ ID NO: 124768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttgcttctgagatttgtc

SEQ ID NO: 124769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttgcttctgagatttgtcc

SEQ ID NO: 124770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcttctgagatttgtcctg

SEQ ID NO: 124771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttctgagatttgtcctgg

SEQ ID NO: 124772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttctgagatttgtcctggg

SEQ ID NO: 124773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgagatttgtcctggggct

SEQ ID NO: 124774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgagatttgtcctggggctt

SEQ ID NO: 124775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agatttgtcctggggctttg

SEQ ID NO: 124776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcctggggctttggacctt

SEQ ID NO: 124777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcctggggctttggacctta

SEQ ID NO: 124778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gggctttggaccttacattc

SEQ ID NO: 124779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggaccttacattcttgact

SEQ ID NO: 124780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaccttacattcttgactt

SEQ ID NO: 124781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaccttacattcttgacttg

SEQ ID NO: 124782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acattcttgacttgtaagat

SEQ ID NO: 124783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cattcttgacttgtaagatg

SEQ ID NO: 124784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgacttgtaagatgtgcta

SEQ ID NO: 124785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacttgtaagatgtgctatt

SEQ ID NO: 124786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acttgtaagatgtgctattg

SEQ ID NO: 124787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtaagatgtgctattgaagg

SEQ ID NO: 124788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagatgtgctattgaagga

SEQ ID NO: 124789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgaaggaaggaaacttcag

SEQ ID NO: 124790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaggaaggaaacttcagtga

SEQ ID NO: 124791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagtgactgagactgtgcaa

SEQ ID NO: 124792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtgactgagactgtgcaat

SEQ ID NO: 124793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agactgtgcaatgaaggtga

SEQ ID NO: 124794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgcaatgaaggtgaactagc

SEQ ID NO: 124795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctcacttgtgataattctc

SEQ ID NO: 124796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acttgtgataattctcagtg

SEQ ID NO: 124797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgataattctcagtgccat

SEQ ID NO: 124798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgataattctcagtgccata

SEQ ID NO: 124799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcagtgccatatcctggaca

SEQ ID NO: 124800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agtgccatatcctggacaaa

SEQ ID NO: 124801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gacaaatcgccttctcttcc

SEQ ID NO: 124802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcttccctgattggtggta

SEQ ID NO: 124803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttccctgattggtggtag

SEQ ID NO: 124804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttccctgattggtggtagat

SEQ ID NO: 124805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctgattggtggtagatat

SEQ ID NO: 124806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctgattggtggtagatata

SEQ ID NO: 124807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attggtggtagatataggaa

SEQ ID NO: 124808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtggtagatataggaagaag

SEQ ID NO: 124809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aactgcaataggaataatgg

SEQ ID NO: 124810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caataggaataatggtcttt

SEQ ID NO: 124811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttattagatgcaagcaat

SEQ ID NO: 124812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttattagatgcaagcaatg

SEQ ID NO: 124813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattagatgcaagcaatgc

SEQ ID NO: 124814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattagatgcaagcaatgcc

SEQ ID NO: 124815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attagatgcaagcaatgcca

SEQ ID NO: 124816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttagatgcaagcaatgccac

SEQ ID NO: 124817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatgcaagcaatgccacatt

SEQ ID NO: 124818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttatttttaaaattttat

SEQ ID NO: 124819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatttttaaaattttattt

SEQ ID NO: 124820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttttaaaattttatttt

SEQ ID NO: 124821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttttaaaattttattttt

SEQ ID NO: 124822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttaaaattttattttta

SEQ ID NO: 124823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaattttatttttagag

SEQ ID NO: 124824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaattttatttttagagc

SEQ ID NO: 124825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaattttatttttagagca

SEQ ID NO: 124826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattttatttttagagcaa

SEQ ID NO: 124827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttttagagcaattttag

SEQ ID NO: 124828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttttagagcaattttagg

SEQ ID NO: 124829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttagagcaattttaggt

SEQ ID NO: 124830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagagcaattttaggttca

SEQ ID NO: 124831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagagcaattttaggttcac

SEQ ID NO: 124832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agagcaattttaggttcaca

SEQ ID NO: 124833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagcaattttaggttcacag

SEQ ID NO: 124834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taggttcacagcaaaactga

SEQ ID NO: 124835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggttcacagcaaaactgaa

SEQ ID NO: 124836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggttcacagcaaaactgaag

SEQ ID NO: 124837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acagcaaaactgaagggagg

SEQ ID NO: 124838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagggagggtacagagattt

SEQ ID NO: 124839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccacataaccgctactccc

SEQ ID NO: 124840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccacataaccgctactccca

SEQ ID NO: 124841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcccacacaagaatagcct

SEQ ID NO: 124842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccacacaagaatagcctccc

SEQ ID NO: 124843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccccattatcaacattcccc

SEQ ID NO: 124844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaacattccccaccagaat

SEQ ID NO: 124845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccaccagaatgaaacattt

SEQ ID NO: 124846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttaaaattaatgaacttac

SEQ ID NO: 124847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaaaattaatgaacttact

SEQ ID NO: 124848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattaatgaacttactttg

SEQ ID NO: 124849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgaacttactttgaggttt

SEQ ID NO: 124850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actttgaggtttcattatct

SEQ ID NO: 124851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttgaggtttcattatctc

SEQ ID NO: 124852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaggtttcattatctccca

SEQ ID NO: 124853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaggtttcattatctcccaa

SEQ ID NO: 124854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggtttcattatctcccaag

SEQ ID NO: 124855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattatctcccaaggtctgt

SEQ ID NO: 124856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attatctcccaaggtctgta

SEQ ID NO: 124857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctcccaaggtctgtagttc

SEQ ID NO: 124858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaaggtctgtagttcacat

SEQ ID NO: 124859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagttcacatttagggttag

SEQ ID NO: 124860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acatttagggttagctcatg

SEQ ID NO: 124861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agggttagctcatggtgttg

SEQ ID NO: 124862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gggttagctcatggtgttgt

SEQ ID NO: 124863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctcatggtgttgtccattc

SEQ ID NO: 124864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atggtgttgtccattctatg

SEQ ID NO: 124865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tccattctatggggttaggc

SEQ ID NO: 124866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatggggttaggcaaatata

SEQ ID NO: 124867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggggttaggcaaatatata

SEQ ID NO: 124868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggcaaatatataatgacatg

SEQ ID NO: 124869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagtatcttacagagtaatt

SEQ ID NO: 124870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acagagtaatttcagttctc

SEQ ID NO: 124871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagagtaatttcagttctct

SEQ ID NO: 124872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagttctctcctgaattctc

SEQ ID NO: 124873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agttctctcctgaattctct

SEQ ID NO: 124874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctcctgaattctctgtgtt

SEQ ID NO: 124875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcctgaattctctgtgttcc

SEQ ID NO: 124876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgaattctctgtgttccac

SEQ ID NO: 124877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aattctctgtgttccactta

SEQ ID NO: 124878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgtgttccacttattcat

SEQ ID NO: 124879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtgttccacttattcatct

SEQ ID NO: 124880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgttccacttattcatctcc

SEQ ID NO: 124881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacttattcatctcccattt

SEQ ID NO: 124882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attcatctcccatttcaacc

SEQ ID NO: 124883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcatctcccatttcaaccc

SEQ ID NO: 124884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atctcccatttcaacccctg

SEQ ID NO: 124885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccatttcaacccctggcaag

SEQ ID NO: 124886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caacccctggcaagtactga

SEQ ID NO: 124887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacccctggcaagtactgat

SEQ ID NO: 124888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcaagtactgatcattttac

SEQ ID NO: 124889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atcattttactgtctttata

SEQ ID NO: 124890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tactgtctttatagttttgc

SEQ ID NO: 124891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actgtctttatagttttgcc

SEQ ID NO: 124892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgtctttatagttttgcct

SEQ ID NO: 124893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctttatagttttgccttct

SEQ ID NO: 124894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatagttttgccttctccag

SEQ ID NO: 124895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagttttgccttctccagg

SEQ ID NO: 124896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagttttgccttctccagga

SEQ ID NO: 124897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgccttctccaggatatcct

SEQ ID NO: 124898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccttctccaggatatccta

SEQ ID NO: 124899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccttctccaggatatcctat

SEQ ID NO: 124900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctccaggatatcctatagtt

SEQ ID NO: 124901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccaggatatcctatagttg

SEQ ID NO: 124902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caggatatcctatagttgca

SEQ ID NO: 124903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagttgcaataatacagaat

SEQ ID NO: 124904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caataatacagaatatagcc

SEQ ID NO: 124905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcagattgactcctttcact

SEQ ID NO: 124906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagattgactcctttcactt

SEQ ID NO: 124907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agattgactcctttcactta

SEQ ID NO: 124908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actcctttcacttagcaata

SEQ ID NO: 124909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctttcacttagcaatatgct

SEQ ID NO: 124910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcacttagcaatatgctttt

SEQ ID NO: 124911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacttagcaatatgctttta

SEQ ID NO: 124912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acttagcaatatgcttttag

SEQ ID NO: 124913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agcaatatgcttttagtttt

SEQ ID NO: 124914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaatatgcttttagttttc

SEQ ID NO: 124915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttagttttcctccatggctt

SEQ ID NO: 124916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagttttcctccatggcttt

SEQ ID NO: 124917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agttttcctccatggctttt

SEQ ID NO: 124918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttttcctccatggcttttc

SEQ ID NO: 124919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctccatggcttttcatag

SEQ ID NO: 124920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctccatggcttttcatagc

SEQ ID NO: 124921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctccatggcttttcatagct

SEQ ID NO: 124922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catggcttttcatagcttga

SEQ ID NO: 124923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcatagcttgatagctcat

SEQ ID NO: 124924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatagcttgatagctcatt

SEQ ID NO: 124925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catagcttgatagctcattt

SEQ ID NO: 124926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atagcttgatagctcatttc

SEQ ID NO: 124927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatagctcatttctttacag

SEQ ID NO: 124928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atagctcatttctttacagt

SEQ ID NO: 124929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atttctttacagtgctgaat

SEQ ID NO: 124930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttacagtgctgaataata

SEQ ID NO: 124931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttacagtgctgaataatat

SEQ ID NO: 124932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacagtgctgaataatattc

SEQ ID NO: 124933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acagtgctgaataatattcc

SEQ ID NO: 124934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagtgctgaataatattcca

SEQ ID NO: 124935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aataatattccattgactgg

SEQ ID NO: 124936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattgactggtggtaccata

SEQ ID NO: 124937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actggtggtaccatagttta

SEQ ID NO: 124938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtggtaccatagtttattca

SEQ ID NO: 124939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attcattcacctactgaagg

SEQ ID NO: 124940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcattcacctactgaagga

SEQ ID NO: 124941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attcacctactgaaggacat

SEQ ID NO: 124942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acctactgaaggacatcttg

SEQ ID NO: 124943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgaaggacatcttgtttgc

SEQ ID NO: 124944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaggacatcttgtttgcttc

SEQ ID NO: 124945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtttgcttccaagttttagc

SEQ ID NO: 124946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgcttccaagttttagca

SEQ ID NO: 124947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttccaagttttagcaatt

SEQ ID NO: 124948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttccaagttttagcaatta

SEQ ID NO: 124949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaagttttagcaattatgc

SEQ ID NO: 124950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caagttttagcaattatgcg

SEQ ID NO: 124951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagcaattatgcgtaaagcc

SEQ ID NO: 124952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcaattatgcgtaaagcct

SEQ ID NO: 124953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaattatgcgtaaagcctc

SEQ ID NO: 124954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcgtaaagcctctataaac

SEQ ID NO: 124955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tataaacatctttgtgaagg

SEQ ID NO: 124956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaacatctttgtgaaggtt

SEQ ID NO: 124957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtgaaggttactgtgtgga

SEQ ID NO: 124958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgaaggttactgtgtggac

SEQ ID NO: 124959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaaggttactgtgtggaca

SEQ ID NO: 124960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgtgtggacatgttttcaa

SEQ ID NO: 124961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtggacatgttttcaagtc

SEQ ID NO: 124962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaagtcctttgggtgaaca

SEQ ID NO: 124963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caagtcctttgggtgaacat

SEQ ID NO: 124964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagtcctttgggtgaacatc

SEQ ID NO: 124965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgggtgaacatcaaggagca

SEQ ID NO: 124966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggtgaacatcaaggagcac

SEQ ID NO: 124967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggtgaacatcaaggagcaca

SEQ ID NO: 124968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctggatcatatggtgagagt

SEQ ID NO: 124969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatcatatggtgagagtatg

SEQ ID NO: 124970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtttttaaagaaactgcta

SEQ ID NO: 124971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtttttaaagaaactgctac

SEQ ID NO: 124972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaagaaactgctacactg

SEQ ID NO: 124973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaagaaactgctacactgt

SEQ ID NO: 124974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagaaactgctacactgtc

SEQ ID NO: 124975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagaaactgctacactgtcc

SEQ ID NO: 124976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctacactgtcctcaaagtgg

SEQ ID NO: 124977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cactgtcctcaaagtggctg

SEQ ID NO: 124978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcctcaaagtggctggagca

SEQ ID NO: 124979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaagtggctggagcattttg

SEQ ID NO: 124980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagcattttgcattcccacc

SEQ ID NO: 124981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcattcccaccagcaatac

SEQ ID NO: 124982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcattcccaccagcaataca

SEQ ID NO: 124983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattcccaccagcaatacat

SEQ ID NO: 124984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaccagcaatacatgagag

SEQ ID NO: 124985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgttgcctcacatccttgg

SEQ ID NO: 124986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgcctcacatccttggcca

SEQ ID NO: 124987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctcacatccttggccagaa

SEQ ID NO: 124988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acatccttggccagaacttg

SEQ ID NO: 124989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggccagaacttgatatcatc

SEQ ID NO: 124990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gccagaacttgatatcatca

SEQ ID NO: 124991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatatcatcagtgttctgga

SEQ ID NO: 124992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atatcatcagtgttctggat

SEQ ID NO: 124993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggattttggttattccaat

SEQ ID NO: 124994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gattttggttattccaatac

SEQ ID NO: 124995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggttattccaatacatatg

SEQ ID NO: 124996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggttattccaatacatatgt

SEQ ID NO: 124997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gttattccaatacatatgtg

SEQ ID NO: 124998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttccaatacatatgtggtgg

SEQ ID NO: 124999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caatacatatgtggtggtat

SEQ ID NO: 125000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgcccattgttgataccat

SEQ ID NO: 125001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgataccataagtgttatt

SEQ ID NO: 125002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataccataagtgttatttga

SEQ ID NO: 125003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgatttgcatttcccctg

SEQ ID NO: 125004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatttgcatttcccctgtga

SEQ ID NO: 125005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atttgcatttcccctgtgat

SEQ ID NO: 125006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcatttcccctgtgatatat

SEQ ID NO: 125007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catttcccctgtgatatatg

SEQ ID NO: 125008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccctgtgatatatgatgtg

SEQ ID NO: 125009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccctgtgatatatgatgtgg

SEQ ID NO: 125010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgatatatgatgtggatcac

SEQ ID NO: 125011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttatatgcttatttgcaat

SEQ ID NO: 125012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatatgcttatttgcaata

SEQ ID NO: 125013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatatgcttatttgcaatat

SEQ ID NO: 125014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatgcttatttgcaatatg

SEQ ID NO: 125015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatgcttatttgcaatatgt

SEQ ID NO: 125016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttgcaatatgtgcatctt

SEQ ID NO: 125017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgcaatatgtgcatcttc

SEQ ID NO: 125018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaatatgtgcatcttcttt

SEQ ID NO: 125019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caatatgtgcatcttctttg

SEQ ID NO: 125020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttggtctgttaaggtata

SEQ ID NO: 125021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttggtctgttaaggtatat

SEQ ID NO: 125022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggtctgttaaggtatatgg

SEQ ID NO: 125023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtctgttaaggtatatggc

SEQ ID NO: 125024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtctgttaaggtatatggcc

SEQ ID NO: 125025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttaaggtatatggcccattt

SEQ ID NO: 125026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggtatatggcccatttttt

SEQ ID NO: 125027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttcattgggttatttctt

SEQ ID NO: 125028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcattgggttatttcttt

SEQ ID NO: 125029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcattgggttatttctttt

SEQ ID NO: 125030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattgggttatttcttttc

SEQ ID NO: 125031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattgggttatttcttttct

SEQ ID NO: 125032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attgggttatttcttttctt

SEQ ID NO: 125033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggttatttcttttcttgttg

SEQ ID NO: 125034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcttttcttgttgttgag

SEQ ID NO: 125035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttcttgttgttgagttt

SEQ ID NO: 125036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttcttgttgttgagtttt

SEQ ID NO: 125037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcttgttgttgagttttaa

SEQ ID NO: 125038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttgttgttgagttttaag

SEQ ID NO: 125039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgttgttgagttttaagc

SEQ ID NO: 125040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgttgttgagttttaagct

SEQ ID NO: 125041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttgttgagttttaagcttt

SEQ ID NO: 125042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgttgagttttaagcttta

SEQ ID NO: 125043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgagttttaagctttattt

SEQ ID NO: 125044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agttttaagctttatttgta

SEQ ID NO: 125045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagctttatttgtatattt

SEQ ID NO: 125046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagctttatttgtatatttt

SEQ ID NO: 125047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agctttatttgtatattttg

SEQ ID NO: 125048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatttgtatattttggttaa

SEQ ID NO: 125049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttgtatattttggttaac

SEQ ID NO: 125050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgtatattttggttaaca

SEQ ID NO: 125051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatattttggttaacagtc

SEQ ID NO: 125052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatattttggttaacagtca

SEQ ID NO: 125053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggttaacagtcatttgtca

SEQ ID NO: 125054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggttaacagtcatttgtcag

SEQ ID NO: 125055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gttaacagtcatttgtcaga

SEQ ID NO: 125056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acagtcatttgtcagatgtg

SEQ ID NO: 125057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcagatgtgtcttttgcaa

SEQ ID NO: 125058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcagatgtgtcttttgcaaa

SEQ ID NO: 125059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgcaaatatttatctaaca

SEQ ID NO: 125060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcaaatatttatctaacac

SEQ ID NO: 125061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaaatatttatctaacact

SEQ ID NO: 125062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaatatttatctaacactg

SEQ ID NO: 125063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctaacactggcttgttgt

SEQ ID NO: 125064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctaacactggcttgttgtc

SEQ ID NO: 125065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acactggcttgttgtccgtt

SEQ ID NO: 125066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcttgttgtccgtttttgca

SEQ ID NO: 125067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttgtccgtttttgcagagc

SEQ ID NO: 125068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgtccgtttttgcagagca

SEQ ID NO: 125069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tccgtttttgcagagcagaa

SEQ ID NO: 125070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgcagagcagaagttttta

SEQ ID NO: 125071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcagagcagaagtttttaa

SEQ ID NO: 125072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcagagcagaagtttttaat

SEQ ID NO: 125073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagagcagaagtttttaatt

SEQ ID NO: 125074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaattttaatgcagttcac

SEQ ID NO: 125075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattttaatgcagttcacc

SEQ ID NO: 125076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattttaatgcagttcacct

SEQ ID NO: 125077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttaatgcagttcacctt

SEQ ID NO: 125078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatgcagttcaccttagca

SEQ ID NO: 125079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatgcagttcaccttagcaa

SEQ ID NO: 125080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgcagttcaccttagcaat

SEQ ID NO: 125081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accttagcaattatgtctct

SEQ ID NO: 125082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agcaattatgtctcttatag

SEQ ID NO: 125083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaattatgtctcttataga

SEQ ID NO: 125084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtctcttatagattatgcc

SEQ ID NO: 125085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttatagattatgcctttgct

SEQ ID NO: 125086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atagattatgcctttgctgt

SEQ ID NO: 125087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagattatgcctttgctgtt

SEQ ID NO: 125088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcctttgctgttatatcta

SEQ ID NO: 125089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgctgttatatctagaataa

SEQ ID NO: 125090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctgttatatctagaataac

SEQ ID NO: 125091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgttatatctagaataaca

SEQ ID NO: 125092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttatatctagaataacacat

SEQ ID NO: 125093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatctagaataacacatatg

SEQ ID NO: 125094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaataacacatatgttagat

SEQ ID NO: 125095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatacattcttagagtggaa

SEQ ID NO: 125096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttagagtggaatatataatg

SEQ ID NO: 125097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agagtggaatatataatgca

SEQ ID NO: 125098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagtggaatatataatgcat

SEQ ID NO: 125099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacattatatataacctata

SEQ ID NO: 125100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatataacctatatattata

SEQ ID NO: 125101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatattataacatgttatat

SEQ ID NO: 125102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taacatgttatatattatat

SEQ ID NO: 125103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatattatattactatatta

SEQ ID NO: 125104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattactatattatgttata

SEQ ID NO: 125105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctatattatgttataatata

SEQ ID NO: 125106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tattatgttataatatatgt

SEQ ID NO: 125107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgttataatatatgttatgt

SEQ ID NO: 125108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatatatgttatgtataat

SEQ ID NO: 125109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtataatacatatgttgta

SEQ ID NO: 125110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatataatatataacatatt

SEQ ID NO: 125111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatattccactttaagcatc

SEQ ID NO: 125112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cactttaagcatccattaac

SEQ ID NO: 125113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taagcatccattaacaagaa

SEQ ID NO: 125114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagcatccattaacaagaac

SEQ ID NO: 125115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcatccattaacaagaact

SEQ ID NO: 125116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaagaacttactattctca

SEQ ID NO: 125117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actattctcaatatatctag

SEQ ID NO: 125118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctattctcaatatatctagg

SEQ ID NO: 125119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttctcaatatatctaggttc

SEQ ID NO: 125120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaatatatctaggttcttg

SEQ ID NO: 125121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatatatctaggttcttgtt

SEQ ID NO: 125122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggttcttgttagagatcttc

SEQ ID NO: 125123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgttagagatcttcaaaca

SEQ ID NO: 125124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttagagatcttcaaacata

SEQ ID NO: 125125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttagagatcttcaaacataa

SEQ ID NO: 125126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagatcttcaaacataaaat

SEQ ID NO: 125127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaacataaaatcctggaaa

SEQ ID NO: 125128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaacataaaatcctggaaaa

SEQ ID NO: 125129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaaatgataaaaccaaaaa

SEQ ID NO: 125130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttggtctgactgagggatcc

SEQ ID NO: 125131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtctgactgagggatccct

SEQ ID NO: 125132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtctgactgagggatccctt

SEQ ID NO: 125133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actgagggatcccttgcagg

SEQ ID NO: 125134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agggatcccttgcaggattt

SEQ ID NO: 125135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcaggattttccctgtgagc

SEQ ID NO: 125136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caggattttccctgtgagct

SEQ ID NO: 125137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccctgtgagctcataggca

SEQ ID NO: 125138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctgtgagctcataggcaa

SEQ ID NO: 125139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctgtgagctcataggcaaa

SEQ ID NO: 125140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgagctcataggcaaagcat

SEQ ID NO: 125141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataggcaaagcattaggtat

SEQ ID NO: 125142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtatattattcattatttt

SEQ ID NO: 125143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcattattttcccaatttt

SEQ ID NO: 125144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attattttcccaattttctt

SEQ ID NO: 125145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcccaattttctttcat

SEQ ID NO: 125146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcccaattttctttcatgtt

SEQ ID NO: 125147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccaattttctttcatgttc

SEQ ID NO: 125148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccaattttctttcatgttcc

SEQ ID NO: 125149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttcatgttccaactatt

SEQ ID NO: 125150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttcatgttccaactattt

SEQ ID NO: 125151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcatgttccaactattta

SEQ ID NO: 125152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcatgttccaactatttatt

SEQ ID NO: 125153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgttccaactatttattt

SEQ ID NO: 125154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgttccaactatttatttc

SEQ ID NO: 125155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caactatttatttcctttcc

SEQ ID NO: 125156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttatttcctttccatttct

SEQ ID NO: 125157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttcctttccatttctttt

SEQ ID NO: 125158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcctttccatttctttta

SEQ ID NO: 125159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctttccatttcttttatgt

SEQ ID NO: 125160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttccatttcttttatgtg

SEQ ID NO: 125161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccatttcttttatgtgcca

SEQ ID NO: 125162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccatttcttttatgtgccat

SEQ ID NO: 125163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catttcttttatgtgccatt

SEQ ID NO: 125164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttatgtgccattcctag

SEQ ID NO: 125165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttatgtgccattcctagt

SEQ ID NO: 125166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatgtgccattcctagtct

SEQ ID NO: 125167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgtgccattcctagtcta

SEQ ID NO: 125168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgtgccattcctagtctac

SEQ ID NO: 125169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtgccattcctagtctaca

SEQ ID NO: 125170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctagtctacagaacattagc

SEQ ID NO: 125171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtctacagaacattagctgt

SEQ ID NO: 125172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagaacattagctgtttgtg

SEQ ID NO: 125173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctgtttgtgtttttcttgc

SEQ ID NO: 125174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttgtgtttttcttgctctt

SEQ ID NO: 125175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgtttttcttgctcttttg

SEQ ID NO: 125176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtttttcttgctcttttgg

SEQ ID NO: 125177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcttgctcttttggcagcc

SEQ ID NO: 125178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttgctcttttggcagccc

SEQ ID NO: 125179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttgctcttttggcagccct

SEQ ID NO: 125180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgctcttttggcagcccta

SEQ ID NO: 125181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctcttttggcagccctaga

SEQ ID NO: 125182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcttttggcagccctagaa

SEQ ID NO: 125183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttggcagccctagaaatt

SEQ ID NO: 125184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttggcagccctagaaatttt

SEQ ID NO: 125185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggcagccctagaaatttta

SEQ ID NO: 125186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcagccctagaaattttat

SEQ ID NO: 125187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcagccctagaaattttatc

SEQ ID NO: 125188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaattttatcttggtttaa

SEQ ID NO: 125189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcttggtttaaacccaga

SEQ ID NO: 125190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttggtttaaacccagaa

SEQ ID NO: 125191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttggtttaaacccagaaa

SEQ ID NO: 125192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtttaaacccagaaaaagt

SEQ ID NO: 125193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtttaaacccagaaaaagta

SEQ ID NO: 125194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaacccagaaaaagtatctt

SEQ ID NO: 125195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacccagaaaaagtatcttt

SEQ ID NO: 125196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccaaatttcttattaaata

SEQ ID NO: 125197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaaatttcttattaaatac

SEQ ID NO: 125198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaatttcttattaaatact

SEQ ID NO: 125199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttattaaatactacactgc

SEQ ID NO: 125200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttattaaatactacactgca

SEQ ID NO: 125201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attaaatactacactgcaca

SEQ ID NO: 125202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaatactacactgcacag

SEQ ID NO: 125203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatactacactgcacagcct

SEQ ID NO: 125204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cactgcacagccttgagagt

SEQ ID NO: 125205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cacagccttgagagttcatt

SEQ ID NO: 125206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagagttcattaaacactaa

SEQ ID NO: 125207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agagttcattaaacactaaa

SEQ ID NO: 125208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attaaacactaaatgacagc

SEQ ID NO: 125209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacactaaatgacagcgtca

SEQ ID NO: 125210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatgacagcgtcagatgtag

SEQ ID NO: 125211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatttaaagggtaggctt

SEQ ID NO: 125212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatttaaagggtaggcttg

SEQ ID NO: 125213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagggtaggcttgaattaa

SEQ ID NO: 125214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagggtaggcttgaattaag

SEQ ID NO: 125215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaattaagggaaccagacaa

SEQ ID NO: 125216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattaagggaaccagacaaa

SEQ ID NO: 125217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agggaaccagacaaagcctg

SEQ ID NO: 125218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctggttgaaaaagccaata

SEQ ID NO: 125219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttgaaaaagccaataacca

SEQ ID NO: 125220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaaagccaataaccaataa

SEQ ID NO: 125221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctaatcatatttacaactga

SEQ ID NO: 125222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atcatatttacaactgacct

SEQ ID NO: 125223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaactgaccttccgtaact

SEQ ID NO: 125224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caactgaccttccgtaactt

SEQ ID NO: 125225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
accttccgtaacttagatag

SEQ ID NO: 125226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccgtaacttagatagaaaaa

SEQ ID NO: 125227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cgtaacttagatagaaaaat

SEQ ID NO: 125228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agatagaaaaatgtggaaat

SEQ ID NO: 125229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatagaaaaatgtggaaatg

SEQ ID NO: 125230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtcatggaaattaactaac

SEQ ID NO: 125231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actaacatcatacaatccat

SEQ ID NO: 125232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acatcatacaatccatacca

SEQ ID NO: 125233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttcccttagtgagaaat

SEQ ID NO: 125234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttcccttagtgagaaata

SEQ ID NO: 125235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcccttagtgagaaataa

SEQ ID NO: 125236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccttagtgagaaataaatg

SEQ ID NO: 125237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttagtgagaaataaatgg

SEQ ID NO: 125238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtgagaaataaatggatat

SEQ ID NO: 125239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgagaaataaatggatatc

SEQ ID NO: 125240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgtattttccacaattgcc

SEQ ID NO: 125241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtattttccacaattgcca

SEQ ID NO: 125242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tattttccacaattgccact

SEQ ID NO: 125243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccacaattgccactgcaat

SEQ ID NO: 125244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccacaattgccactgcaatt

SEQ ID NO: 125245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacaattgccactgcaattt

SEQ ID NO: 125246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccactgcaattttcaaaact

SEQ ID NO: 125247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caattttcaaaactgtagaa

SEQ ID NO: 125248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaaactgtagaagtttct

SEQ ID NO: 125249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaactgtagaagtttctg

SEQ ID NO: 125250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaactgtagaagtttctgg

SEQ ID NO: 125251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagaagtttctggaagaaca

SEQ ID NO: 125252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctggaagaacaaaaaataga

SEQ ID NO: 125253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggaagaacaaaaaatagac

SEQ ID NO: 125254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaagaacaaaaaatagacag

SEQ ID NO: 125255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggcaataaaattaatacaa

SEQ ID NO: 125256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atacaatactgaaagagttt

SEQ ID NO: 125257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaagagtttgtttttctcta

SEQ ID NO: 125258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttttctctaattaaatag

SEQ ID NO: 125259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttttctctaattaaatagg

SEQ ID NO: 125260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctctaattaaataggatt

SEQ ID NO: 125261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctctaattaaataggatta

SEQ ID NO: 125262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctaattaaataggattag

SEQ ID NO: 125263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctaattaaataggattaga

SEQ ID NO: 125264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taattaaataggattagaaa

SEQ ID NO: 125265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attaaataggattagaaaaa

SEQ ID NO: 125266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataggattagaaaaatact

SEQ ID NO: 125267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaaaatacttttaccttct

SEQ ID NO: 125268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaccttctaatattggctg

SEQ ID NO: 125269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taccttctaatattggctgc

SEQ ID NO: 125270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
accttctaatattggctgca

SEQ ID NO: 125271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccttctaatattggctgcac

SEQ ID NO: 125272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaatattggctgcacggca

SEQ ID NO: 125273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taatattggctgcacggcaa

SEQ ID NO: 125274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atattggctgcacggcaata

SEQ ID NO: 125275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctgcacggcaatattacaa

SEQ ID NO: 125276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cacggcaatattacaaagta

SEQ ID NO: 125277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaagtaagaaaaaacaatt

SEQ ID NO: 125278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctgttgtgaaaatagaag

SEQ ID NO: 125279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttgtgaaaatagaagaat

SEQ ID NO: 125280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgtgaaaatagaagaataa

SEQ ID NO: 125281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaaaatagaagaataaagt

SEQ ID NO: 125282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caagttttgtgtatacatag

SEQ ID NO: 125283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgtatacatagctaaaaa

SEQ ID NO: 125284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgtatacatagctaaaaag

SEQ ID NO: 125285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtatacatagctaaaaagt

SEQ ID NO: 125286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaagtaggattcaaaagta

SEQ ID NO: 125287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaagtagaacttcaaatta

SEQ ID NO: 125288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaattataactaaaaagaa

SEQ ID NO: 125289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaattataactaaaaagaaa

SEQ ID NO: 125290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taactaaaaagaaatagaat

SEQ ID NO: 125291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaagaaatagaatatacaa

SEQ ID NO: 125292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcagacatagattggagtga

SEQ ID NO: 125293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagtgatgagatgggcaaat

SEQ ID NO: 125294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatgaaacaactgaagaaaa

SEQ ID NO: 125295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgaaacaactgaagaaaag

SEQ ID NO: 125296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagaaaagaggtttcctaaa

SEQ ID NO: 125297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctaaatgtattggcatctg

SEQ ID NO: 125298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctaaatgtattggcatctga

SEQ ID NO: 125299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatgtattggcatctgagtg

SEQ ID NO: 125300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcatctgagtgtttgctcgt

SEQ ID NO: 125301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtgtttgctcgtctaattt

SEQ ID NO: 125302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctcgtctaatttgacgtgg

SEQ ID NO: 125303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcgtctaatttgacgtggt

SEQ ID NO: 125304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gtctaatttgacgtggtctg

SEQ ID NO: 125305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttgacgtggtctggattt

SEQ ID NO: 125306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacgtggtctggattttttt

SEQ ID NO: 125307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acgtggtctggatttttttg

SEQ ID NO: 125308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatttttttggccagaaaac

SEQ ID NO: 125309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttggccagaaaactgatg

SEQ ID NO: 125310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttggccagaaaactgatgt

SEQ ID NO: 125311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttggccagaaaactgatgtg

SEQ ID NO: 125312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggccagaaaactgatgtga

SEQ ID NO: 125313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggccagaaaactgatgtgaa

SEQ ID NO: 125314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gccagaaaactgatgtgaag

SEQ ID NO: 125315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgtgaagaaaaataaatgt

SEQ ID NO: 125316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtcttgcatgtagtagatg

SEQ ID NO: 125317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcttgcatgtagtagatgc

SEQ ID NO: 125318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttgcatgtagtagatgct

SEQ ID NO: 125319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gcatgtagtagatgcttagt

SEQ ID NO: 125320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catgtagtagatgcttagta

SEQ ID NO: 125321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtaagtatattaattgatt

SEQ ID NO: 125322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtaagtatattaattgatta

SEQ ID NO: 125323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attgattacttattcctgaa

SEQ ID NO: 125324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attacttattcctgaagaat

SEQ ID NO: 125325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttattcctgaagaattttc

SEQ ID NO: 125326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attcctgaagaattttcccc

SEQ ID NO: 125327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcctgaagaattttcccca

SEQ ID NO: 125328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgaagaattttccccagtg

SEQ ID NO: 125329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagaattttccccagtgtca

SEQ ID NO: 125330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccccagtgtcatagtccac

SEQ ID NO: 125331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccccagtgtcatagtccact

SEQ ID NO: 125332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccagtgtcatagtccactg

SEQ ID NO: 125333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgggtcccttaccctaaca

SEQ ID NO: 125334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
accctaacaatggttttgct

SEQ ID NO: 125335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccctaacaatggttttgctg

SEQ ID NO: 125336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acaatggttttgctgataat

SEQ ID NO: 125337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctgataatgtgctttctg

SEQ ID NO: 125338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctgataatgtgctttctgt

SEQ ID NO: 125339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgataatgtgctttctgtg

SEQ ID NO: 125340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ataatgtgctttctgtggag

SEQ ID NO: 125341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctgtggagttatttttgat

SEQ ID NO: 125342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtggagttatttttgatc

SEQ ID NO: 125343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtggagttatttttgatca

SEQ ID NO: 125344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggagttatttttgatcaaa

SEQ ID NO: 125345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttgatcaaaactattgt

SEQ ID NO: 125346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgatcaaaactattgttat

SEQ ID NO: 125347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgatcaaaactattgttatc

SEQ ID NO: 125348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatcaaaactattgttatcg

SEQ ID NO: 125349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcaaaactattgttatcga

SEQ ID NO: 125350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgttatcgacattcccttg

SEQ ID NO: 125351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttatcgacattcccttgtag

SEQ ID NO: 125352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcgacattcccttgtagaag

SEQ ID NO: 125353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccttgtagaagtcttccatt

SEQ ID NO: 125354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtagaagtcttccattagat

SEQ ID NO: 125355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagaagtcttccattagata

SEQ ID NO: 125356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccattagataaggggacaaa

SEQ ID NO: 125357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattagataaggggacaaaa

SEQ ID NO: 125358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gataaggggacaaaatatat

SEQ ID NO: 125359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gttttcagtcattgggcaac

SEQ ID NO: 125360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagtcattgggcaacatta

SEQ ID NO: 125361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagtcattgggcaacattat

SEQ ID NO: 125362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtcattgggcaacattatc

SEQ ID NO: 125363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggcaacattatctataagac

SEQ ID NO: 125364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctataagacagtgatccct

SEQ ID NO: 125365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taagacagtgatccctagag

SEQ ID NO: 125366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gagaagagaaagaaagtgag

SEQ ID NO: 125367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgattgtctctgcatactac

SEQ ID NO: 125368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctctgcatactacacaaag

SEQ ID NO: 125369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcatactacacaaagtttc

SEQ ID NO: 125370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catactacacaaagtttcta

SEQ ID NO: 125371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacaaagtttctaaaccaca

SEQ ID NO: 125372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaaaccacagctcaggaag

SEQ ID NO: 125373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaaccacagctcaggaaga

SEQ ID NO: 125374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaccacagctcaggaagatg

SEQ ID NO: 125375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggaagatggaaacatgaag

SEQ ID NO: 125376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gataggctgagggagctaga

SEQ ID NO: 125377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataggctgagggagctagaa

SEQ ID NO: 125378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agggagctagaatttgttta

SEQ ID NO: 125379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaatttgtttatttgggaca

SEQ ID NO: 125380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttatttgggacaggacac

SEQ ID NO: 125381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttatttgggacaggacacc

SEQ ID NO: 125382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttgggacaggacacctaa

SEQ ID NO: 125383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgggacaggacacctaag

SEQ ID NO: 125384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggacaggacacctaagaca

SEQ ID NO: 125385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggacaggacacctaagacaa

SEQ ID NO: 125386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agacaagggagctgaacaga

SEQ ID NO: 125387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacagagagtataccagaga

SEQ ID NO: 125388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagaaagagacctcaagttt

SEQ ID NO: 125389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagtttttgcttgacagcat

SEQ ID NO: 125390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgcttgacagcattctgca

SEQ ID NO: 125391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcttgacagcattctgcaa

SEQ ID NO: 125392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttgacagcattctgcaat

SEQ ID NO: 125393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttgacagcattctgcaatt

SEQ ID NO: 125394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacagcattctgcaattgtg

SEQ ID NO: 125395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acagcattctgcaattgtgt

SEQ ID NO: 125396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcaattgtgtgaaaacaaa

SEQ ID NO: 125397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caattgtgtgaaaacaaaaa

SEQ ID NO: 125398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtgaaaacaaaaataccct

SEQ ID NO: 125399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agccagagaaagaactacag

SEQ ID NO: 125400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagtcatgcattgcctaaca

SEQ ID NO: 125401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctaacaatggagatatgta

SEQ ID NO: 125402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acaatggagatatgtaccga

SEQ ID NO: 125403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggcaattttaacatcataga

SEQ ID NO: 125404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacatcatagagacagtac

SEQ ID NO: 125405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacatcatagagacagtact

SEQ ID NO: 125406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatcatagagacagtactt

SEQ ID NO: 125407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acacaaacctagatggtata

SEQ ID NO: 125408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacaaacctagatggtatag

SEQ ID NO: 125409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatggtatagtctactacat

SEQ ID NO: 125410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctacatacttagtctttatg

SEQ ID NO: 125411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catacttagtctttatggta

SEQ ID NO: 125412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtctttatggtatagccta

SEQ ID NO: 125413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtctttatggtatagcctat

SEQ ID NO: 125414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatggtatagcctattgctt

SEQ ID NO: 125415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atggtatagcctattgcttc

SEQ ID NO: 125416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggtatagcctattgcttct

SEQ ID NO: 125417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgcttctaggctataaacc

SEQ ID NO: 125418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttctaggctataaacctgt

SEQ ID NO: 125419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaggctataaacctgtaca

SEQ ID NO: 125420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taggctataaacctgtacaa

SEQ ID NO: 125421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggctataaacctgtacaaca

SEQ ID NO: 125422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaacctgtacaacatgtta

SEQ ID NO: 125423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tacaacatgttactgtactg

SEQ ID NO: 125424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgtactgagacaattgtaa

SEQ ID NO: 125425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tactgagacaattgtaacac

SEQ ID NO: 125426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agacaattgtaacacagtgg

SEQ ID NO: 125427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taacacagtggtatttttgt

SEQ ID NO: 125428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtgtctaatcatacctaa

SEQ ID NO: 125429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgtctaatcatacctaaa

SEQ ID NO: 125430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgtctaatcatacctaaac

SEQ ID NO: 125431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtctaatcatacctaaaca

SEQ ID NO: 125432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atcatacctaaacatagaaa

SEQ ID NO: 125433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacatagaaaagttacagta

SEQ ID NO: 125434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagtaaaaatacagtattat

SEQ ID NO: 125435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taatctgtgggaccaccatc

SEQ ID NO: 125436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgggaccaccatcatatatg

SEQ ID NO: 125437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tccttgactgaagtgttatc

SEQ ID NO: 125438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gactgaagtgttatctggca

SEQ ID NO: 125439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actgaagtgttatctggcac

SEQ ID NO: 125440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagtgttatctggcacatga

SEQ ID NO: 125441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctggcacatgactgacatg

SEQ ID NO: 125442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcacatgactgacatgactg

SEQ ID NO: 125443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acatgactgtaatcttaagt

SEQ ID NO: 125444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taatcttaagtagcaggtta

SEQ ID NO: 125445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagtagcaggttaaaaattc

SEQ ID NO: 125446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtagcaggttaaaaattct

SEQ ID NO: 125447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaattcttggacctcacac

SEQ ID NO: 125448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttggacctcacacagggata

SEQ ID NO: 125449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggacctcacacagggatagt

SEQ ID NO: 125450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gacctcacacagggatagta

SEQ ID NO: 125451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acacagggatagtaatattt

SEQ ID NO: 125452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcctccccagtcaaagtg

SEQ ID NO: 125453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcctccccagtcaaagtga

SEQ ID NO: 125454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcctccccagtcaaagtgaa

SEQ ID NO: 125455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cccagtcaaagtgaaaagac

SEQ ID NO: 125456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaacacaggagatattggg

SEQ ID NO: 125457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggtagactctgcagaagggt

SEQ ID NO: 125458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcagaagggtcttatctta

SEQ ID NO: 125459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagaagggtcttatcttagc

SEQ ID NO: 125460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atcttagcagtggggctgaa

SEQ ID NO: 125461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttagcagtggggctgaat

SEQ ID NO: 125462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agcagtggggctgaattaac

SEQ ID NO: 125463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcagtggggctgaattaact

SEQ ID NO: 125464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aattaactttaactaacgtt

SEQ ID NO: 125465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actttaactaacgttgctct

SEQ ID NO: 125466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taactaacgttgctctggat

SEQ ID NO: 125467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactaacgttgctctggatt

SEQ ID NO: 125468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actaacgttgctctggattt

SEQ ID NO: 125469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acgttgctctggatttatcc

SEQ ID NO: 125470-125500 - skipped (31 entries)

SEQ ID NO: 125501 - RNA, 100 nt, synthetic construct
  source 1..100: mol_type = other RNA; note = chemically synthesized
  misc_difference 1: note = modified_base - n is a, c, g, u, or other
  misc_difference 2: note = modified_base - n is a, c, g, u, or other
  misc_difference 3: note = modified_base - n is a, c, g, u, or other
  misc_difference 4: note = modified_base - n is a, c, g, u, or other
  misc_difference 5: note = modified_base - n is a, c, g, u, or other
  misc_difference 6: note = modified_base - n is a, c, g, u, or other
  misc_difference 7: note = modified_base - n is a, c, g, u, or other
  misc_difference 8: note = modified_base - n is a, c, g, u, or other
  misc_difference 9: note = modified_base - n is a, c, g, u, or other
  misc_difference 10: note = modified_base - n is a, c, g, u, or other
  misc_difference 11: note = modified_base - n is a, c, g, u, or other
  misc_difference 12: note = modified_base - n is a, c, g, u, or other
  misc_difference 13: note = modified_base - n is a, c, g, u, or other
  misc_difference 14: note = modified_base - n is a, c, g, u, or other
  misc_difference 15: note = modified_base - n is a, c, g, u, or other
  misc_difference 16: note = modified_base - n is a, c, g, u, or other
  misc_difference 17: note = modified_base - n is a, c, g, u, or other
  misc_difference 18: note = modified_base - n is a, c, g, u, or other
  misc_difference 19: note = modified_base - n is a, c, g, u, or other
  misc_difference 20: note = modified_base - n is a, c, g, u, or other
  misc_difference 1: note = a, c, g, u, or other may or may not be 2'-O-methyl phosphorothioate modified
  misc_difference 2: note = a, c, g, u, or other may or may not be 2'-O-methyl phosphorothioate modified
  misc_difference 3: note = a, c, g, u, or other may or may not be 2'-O-methyl phosphorothioate modified
  misc_difference 4: note = a, c, g, u, or other may or may not be 2'-O-methyl phosphorothioate modified
  misc_difference 5: note = a, c, g, u, or other may or may not be 2'-O-methyl phosphorothioate modified
  misc_difference 6: note = a, c, g, u, or other may or may not be 2'-O-methyl phosphorothioate modified
  misc_difference 7: note = a, c, g, u, or other may or may not be 2'-O-methyl phosphorothioate modified
  misc_difference 8: note = a, c, g, u, or other may or may not be 2'-O-methyl phosphorothioate modified
  misc_difference 9: note = a, c, g, u, or other may or may not be 2'-O-methyl phosphorothioate modified
  misc_difference 10: note = a, c, g, u, or other may or may not be 2'-O-methyl phosphorothioate modified
  misc_difference 11: note = a, c, g, u, or other may or may not be 2'-O-methyl phosphorothioate modified
  misc_difference 12: note = a, c, g, u, or other may or may not be 2'-O-methyl phosphorothioate modified
  misc_difference 13: note = a, c, g, u, or other may or may not be 2'-O-methyl phosphorothioate modified
  misc_difference 14: note = a, c, g, u, or other may or may not be 2'-O-methyl phosphorothioate modified
  misc_difference 15: note = a, c, g, u, or other may or may not be 2'-O-methyl phosphorothioate modified
  misc_difference 16: note = a, c, g, u, or other may or may not be 2'-O-methyl phosphorothioate modified
  misc_difference 17: note = a, c, g, u, or other may or may not be 2'-O-methyl phosphorothioate modified
  misc_difference 18: note = a, c, g, u, or other may or may not be 2'-O-methyl phosphorothioate modified
  misc_difference 19: note = a, c, g, u, or other may or may not be 2'-O-methyl phosphorothioate modified
  misc_difference 20: note = a, c, g, u, or other may or may not be 2'-O-methyl phosphorothioate modified
  misc_difference 21: note = guanosine may or may not be 2'-O-methyl phosphorothioate modified
  misc_difference 22: note = uridine may or may not be 2'-O-methyl phosphorothioate modified
  misc_difference 23: note = uridine may or may not be 2'-O-methyl phosphorothioate modified
  misc_difference 24: note = uridine may or may not be 2'-O-methyl phosphorothioate modified
  misc_difference 25: note = uridine may or may not be 2'-O-methyl phosphorothioate modified
  misc_difference 26: note = adenosine may or may not be 2'-O-methyl phosphorothioate modified
  misc_difference 27: note = guanosine may or may not be 2'-O-methyl phosphorothioate modified
  misc_difference 28: note = adenosine may or may not be 2'-O-methyl phosphorothioate modified
  misc_difference 29: note = guanosine may or may not be 2'-O-methyl phosphorothioate modified
  misc_difference 30: note = cytosine may or may not be 2'-O-methyl phosphorothioate modified
  misc_difference 31: note = uridine may or may not be 2'-O-methyl phosphorothioate modified
  misc_difference 32: note = adenosine may or may not be 2'-O-methyl phosphorothioate modified
  misc_difference 33: note = guanosine may or may not be 2'-O-methyl phosphorothioate modified
  misc_difference 34: note = adenosine may or may not be 2'-O-methyl phosphorothioate modified
  misc_difference 35: note = adenosine may or may not be 2'-O-methyl phosphorothioate modified
  misc_difference 36: note = adenosine may or may not be 2'-O-methyl phosphorothioate modified
  misc_difference 37: note = uridine may or may not be 2'-O-methyl phosphorothioate modified
  misc_difference 38: note = adenosine may or may not be 2'-O-methyl phosphorothioate modified
  misc_difference 39: note = guanosine may or may not be 2'-O-methyl phosphorothioate modified
  misc_difference 40: note = cytosine may or may not be 2'-O-methyl phosphorothioate modified
  misc_difference 41: note = adenosine may or may not be 2'-O-methyl phosphorothioate modified
  misc_difference 42: note = adenosine may or may not be 2'-O-methyl phosphorothioate modified
  misc_difference 43: note = guanosine may or may not be 2'-O-methyl phosphorothioate modified
  misc_difference 44: note = uridine may or may not be 2'-O-methyl phosphorothioate modified
  misc_difference 45: note = uridine may or may not be 2'-O-methyl phosphorothioate modified
  misc_difference 46: note = adenosine may or may not be 2'-O-methyl phosphorothioate modified
  misc_difference 47: note = adenosine may or may not be 2'-O-methyl phosphorothioate modified
  misc_difference 48: note = adenosine may or may not be 2'-O-methyl phosphorothioate modified
  misc_difference 49: note = adenosine may or may not be 2'-O-methyl phosphorothioate modified
  misc_difference 50: note = uridine may or may not be 2'-O-methyl phosphorothioate modified
  misc_difference 51: note = adenosine may or may not be 2'-O-methyl phosphorothioate modified
  misc_difference 52: note = adenosine may or may not be 2'-O-methyl phosphorothioate modified
  misc_difference 53: note = guanosine may or may not be 2'-O-methyl phosphorothioate modified
  misc_difference 54: note = guanosine may or may not be 2'-O-methyl phosphorothioate modified
  misc_difference 55: note = cytosine may or may not be 2'-O-methyl phosphorothioate modified
  misc_difference 56: note = uridine may or may not be 2'-O-methyl phosphorothioate modified
  misc_difference 57: note = adenosine may or may not be 2'-O-methyl phosphorothioate modified
  misc_difference 58: note = guanosine may or may not be 2'-O-methyl phosphorothioate modified
  misc_difference 59: note = uridine may or may not be 2'-O-methyl phosphorothioate modified
  misc_difference 60: note = cytosine may or may not be 2'-O-methyl phosphorothioate modified
  misc_difference 61: note = cytosine may or may not be 2'-O-methyl phosphorothioate modified
  misc_difference 62: note = guanosine may or may not be 2'-O-methyl phosphorothioate modified
  misc_difference 63: note = uridine may or may not be 2'-O-methyl phosphorothioate modified
  misc_difference 64: note = uridine may or may not be 2'-O-methyl phosphorothioate modified
  misc_difference 65: note = adenosine may or may not be 2'-O-methyl phosphorothioate modified
  misc_difference 66: note = uridine may or may not be 2'-O-methyl phosphorothioate modified
  misc_difference 67: note = cytosine may or may not be 2'-O-methyl phosphorothioate modified
  misc_difference 68: note = adenosine may or may not be 2'-O-methyl phosphorothioate modified
  misc_difference 69: note = adenosine may or may not be 2'-O-methyl phosphorothioate modified
  misc_difference 70: note = cytosine may or may not be 2'-O-methyl phosphorothioate modified
  misc_difference 71: note = uridine may or may not be 2'-O-methyl phosphorothioate modified
  misc_difference 72: note = uridine may or may not be 2'-O-methyl phosphorothioate modified
  misc_difference 73: note = guanosine may or may not be 2'-O-methyl phosphorothioate modified
  misc_difference 74: note = adenosine may or may not be 2'-O-methyl phosphorothioate modified
  misc_difference 75: note = adenosine may or may not be 2'-O-methyl phosphorothioate modified
  misc_difference 76: note = adenosine may or may not be 2'-O-methyl phosphorothioate modified
  misc_difference 77: note = adenosine may or may not be 2'-O-methyl phosphorothioate modified
  misc_difference 78: note = adenosine may or may not be 2'-O-methyl phosphorothioate modified
  misc_difference 79: note = guanosine may or may not be 2'-O-methyl phosphorothioate modified
  misc_difference 80: note = uridine may or may not be 2'-O-methyl phosphorothioate modified
  misc_difference 81: note = guanosine may or may not be 2'-O-methyl phosphorothioate modified
  misc_difference 82: note = guanosine may or may not be 2'-O-methyl phosphorothioate modified
  misc_difference 83: note = cytosine may or may not be 2'-O-methyl phosphorothioate modified
  misc_difference 84: note = adenosine may or may not be 2'-O-methyl phosphorothioate modified
  misc_difference 85: note = cytosine may or may not be 2'-O-methyl phosphorothioate modified
  misc_difference 86: note = cytosine may or may not be 2'-O-methyl phosphorothioate modified
  misc_difference 87: note = guanosine may or may not be 2'-O-methyl phosphorothioate modified
  misc_difference 88: note = adenosine may or may not be 2'-O-methyl phosphorothioate modified
  misc_difference 89: note = guanosine may or may not be 2'-O-methyl phosphorothioate modified
  misc_difference 90: note = uridine may or may not be 2'-O-methyl phosphorothioate modified
  misc_difference 91: note = cytosine may or may not be 2'-O-methyl phosphorothioate modified
  misc_difference 92: note = guanosine may or may not be 2'-O-methyl phosphorothioate modified
  misc_difference 93: note = guanosine may or may not be 2'-O-methyl phosphorothioate modified
  misc_difference 94: note = uridine may or may not be 2'-O-methyl phosphorothioate modified
  misc_difference 95: note = guanosine may or may not be 2'-O-methyl phosphorothioate modified
  misc_difference 96: note = cytosine may or may not be 2'-O-methyl phosphorothioate modified
  misc_difference 97: note = uridine may or may not be 2'-O-methyl phosphorothioate modified
  misc_difference 98: note = uridine may or may not be 2'-O-methyl phosphorothioate modified
  misc_difference 99: note = uridine may or may not be 2'-O-methyl phosphorothioate modified
  misc_difference 100: note = uridine may or may not be 2'-O-methyl phosphorothioate modified
nnnnnnnnnnnnnnnnnnnngttttagagctagaaatagcaagttaaaataaggctagtccgttatcaacttgaaaaagtggcaccgagtcggtgctttt

SEQ ID NO: 125502 - RNA, 96 nt, synthetic construct
  source 1..96: mol_type = other RNA; note = chemically synthesized
  misc_difference 1: note = modified_base - n is a, c, g, u, or other
  misc_difference 2: note = modified_base - n is a, c, g, u, or other
  misc_difference 3: note = modified_base - n is a, c, g, u, or other
  misc_difference 4: note = modified_base - n is a, c, g, u, or other
  misc_difference 5: note = modified_base - n is a, c, g, u, or other
  misc_difference 6: note = modified_base - n is a, c, g, u, or other
  misc_difference 7: note = modified_base - n is a, c, g, u, or other
  misc_difference 8: note = modified_base - n is a, c, g, u, or other
  misc_difference 9: note = modified_base - n is a, c, g, u, or other
  misc_difference 10: note = modified_base - n is a, c, g, u, or other
  misc_difference 11: note = modified_base - n is a, c, g, u, or other
  misc_difference 12: note = modified_base - n is a, c, g, u, or other
  misc_difference 13: note = modified_base - n is a, c, g, u, or other
  misc_difference 14: note = modified_base - n is a, c, g, u, or other
  misc_difference 15: note = modified_base - n is a, c, g, u, or other
  misc_difference 16: note = modified_base - n is a, c, g, u, or other
  misc_difference 17: note = modified_base - n is a, c, g, u, or other
  misc_difference 18: note = modified_base - n is a, c, g, u, or other
  misc_difference 19: note = modified_base - n is a, c, g, u, or other
  misc_difference 20: note = modified_base - n is a, c, g, u, or other
  misc_difference 1: note = a, c, g, u, or other may or may not be 2'-O-methyl phosphorothioate modified
  misc_difference 2: note = a, c, g, u, or other may or may not be 2'-O-methyl phosphorothioate modified
  misc_difference 3: note = a, c, g, u, or other may or may not be 2'-O-methyl phosphorothioate modified
  misc_difference 4: note = a, c, g, u, or other may or may not be 2'-O-methyl phosphorothioate modified
  misc_difference 5: note = a, c, g, u, or other may or may not be 2'-O-methyl phosphorothioate modified
  misc_difference 6: note = a, c, g, u, or other may or may not be 2'-O-methyl phosphorothioate modified
  misc_difference 7: note = a, c, g, u, or other may or may not be 2'-O-methyl phosphorothioate modified
  misc_difference 8: note = a, c, g, u, or other may or may not be 2'-O-methyl phosphorothioate modified
  misc_difference 9: note = a, c, g, u, or other may or may not be 2'-O-methyl phosphorothioate modified
  misc_difference 10: note = a, c, g, u, or other may or may not be 2'-O-methyl phosphorothioate modified
  misc_difference 11: note = a, c, g, u, or other may or may not be 2'-O-methyl phosphorothioate modified
  misc_difference 12: note = a, c, g, u, or other may or may not be 2'-O-methyl phosphorothioate modified
  misc_difference 13: note = a, c, g, u, or other may or may not be 2'-O-methyl phosphorothioate modified
  misc_difference 14: note = a, c, g, u, or other may or may not be 2'-O-methyl phosphorothioate modified
  misc_difference 15: note = a, c, g, u, or other may or may not be 2'-O-methyl phosphorothioate modified
  misc_difference 16: note = a, c, g, u, or other may or may not be 2'-O-methyl phosphorothioate modified
  misc_difference 17: note = a, c, g, u, or other may or may not be 2'-O-methyl phosphorothioate modified
  misc_difference 18: note = a, c, g, u, or other may or may not be 2'-O-methyl phosphorothioate modified
  misc_difference 19: note = a, c, g, u, or other may or may not be 2'-O-methyl phosphorothioate modified
  misc_difference 20: note = a, c, g, u, or other may or may not be 2'-O-methyl phosphorothioate modified
  misc_difference 21: note = guanosine may or may not be 2'-O-methyl phosphorothioate modified
  misc_difference 22: note = uridine may or may not be 2'-O-methyl phosphorothioate modified
  misc_difference 23: note = uridine may or may not be 2'-O-methyl phosphorothioate modified
  misc_difference 24: note = uridine may or may not be 2'-O-methyl phosphorothioate modified
  misc_difference 25: note = uridine may or may not be 2'-O-methyl phosphorothioate modified
  misc_difference 26: note = adenosine may or may not be 2'-O-methyl phosphorothioate modified
  misc_difference 27: note = guanosine may or may not be 2'-O-methyl phosphorothioate modified
  misc_difference 28: note = adenosine may or may not be 2'-O-methyl phosphorothioate modified
  misc_difference 29: note = guanosine may or may not be 2'-O-methyl phosphorothioate modified
  misc_difference 30: note = cytosine may or may not be 2'-O-methyl phosphorothioate modified
  misc_difference 31: note = uridine may or may not be 2'-O-methyl phosphorothioate modified
  misc_difference 32: note = adenosine may or may not be 2'-O-methyl phosphorothioate modified
  misc_difference 33: note = guanosine may or may not be 2'-O-methyl phosphorothioate modified
  misc_difference 34: note = adenosine may or may not be 2'-O-methyl phosphorothioate modified
  misc_difference 35: note = adenosine may or may not be 2'-O-methyl phosphorothioate modified
  misc_difference 36: note = adenosine may or may not be 2'-O-methyl phosphorothioate modified
  misc_difference 37: note = uridine may or may not be 2'-O-methyl phosphorothioate modified
  misc_difference 38: note = adenosine may or may not be 2'-O-methyl phosphorothioate modified
  misc_difference 39: note = guanosine may or may not be 2'-O-methyl phosphorothioate modified
  misc_difference 40: note = cytosine may or may not be 2'-O-methyl phosphorothioate modified
  misc_difference 41: note = adenosine may or may not be 2'-O-methyl phosphorothioate modified
  misc_difference 42: note = adenosine may or may not be 2'-O-methyl phosphorothioate modified
  misc_difference 43: note = guanosine may or may not be 2'-O-methyl phosphorothioate modified
  misc_difference 44: note = uridine may or may not be 2'-O-methyl phosphorothioate modified
  misc_difference 45: note = uridine may or may not be 2'-O-methyl phosphorothioate modified
  misc_difference 46: note = adenosine may or may not be 2'-O-methyl phosphorothioate modified
  misc_difference 47: note = adenosine may or may not be 2'-O-methyl phosphorothioate modified
  misc_difference 48: note = adenosine may or may not be 2'-O-methyl phosphorothioate modified
  misc_difference 49: note = adenosine may or may not be 2'-O-methyl phosphorothioate modified
  misc_difference 50: note = uridine may or may not be 2'-O-methyl phosphorothioate modified
  misc_difference 51: note = adenosine may or may not be 2'-O-methyl phosphorothioate modified
  misc_difference 52: note = adenosine may or may not be 2'-O-methyl phosphorothioate modified
  misc_difference 53: note = guanosine may or may not be 2'-O-methyl phosphorothioate modified
  misc_difference 54: note = guanosine may or may not be 2'-O-methyl phosphorothioate modified
  misc_difference 55: note = cytosine may or may not be 2'-O-methyl phosphorothioate modified
  misc_difference 56: note = uridine may or may not be 2'-O-methyl phosphorothioate modified
  misc_difference 57: note = adenosine may or may not be 2'-O-methyl phosphorothioate modified
  misc_difference 58: note = guanosine may or may not be 2'-O-methyl phosphorothioate modified
  misc_difference 59: note = uridine may or may not be 2'-O-methyl phosphorothioate modified
  misc_difference 60: note = cytosine may or may not be 2'-O-methyl phosphorothioate modified
  misc_difference 61: note = cytosine may or may not be 2'-O-methyl phosphorothioate modified
  misc_difference 62: note = guanosine may or may not be 2'-O-methyl phosphorothioate modified
  misc_difference 63: note = uridine may or may not be 2'-O-methyl phosphorothioate modified
  misc_difference 64: note = uridine may or may not be 2'-O-methyl phosphorothioate modified
  misc_difference 65: note = adenosine may or may not be 2'-O-methyl phosphorothioate modified
  misc_difference 66: note = uridine may or may not be 2'-O-methyl phosphorothioate modified
  misc_difference 67: note = cytosine may or may not be 2'-O-methyl phosphorothioate modified
  misc_difference 68: note = adenosine may or may not be 2'-O-methyl phosphorothioate modified
  misc_difference 69: note = adenosine may or may not be 2'-O-methyl phosphorothioate modified
  misc_difference 70: note = cytosine may or may not be 2'-O-methyl phosphorothioate modified
  misc_difference 71: note = uridine may or may not be 2'-O-methyl phosphorothioate modified
  misc_difference 72: note = uridine may or may not be 2'-O-methyl phosphorothioate modified
  misc_difference 73: note = guanosine may or may not be 2'-O-methyl phosphorothioate modified
  misc_difference 74: note = adenosine may or may not be 2'-O-methyl phosphorothioate modified
  misc_difference 75: note = adenosine may or may not be 2'-O-methyl phosphorothioate modified
  misc_difference 76: note = adenosine may or may not be 2'-O-methyl phosphorothioate modified
  misc_difference 77: note = adenosine may or may not be 2'-O-methyl phosphorothioate modified
  misc_difference 78: note = adenosine may or may not be 2'-O-methyl phosphorothioate modified
  misc_difference 79: note = guanosine may or may not be 2'-O-methyl phosphorothioate modified
  misc_difference 80: note = uridine may or may not be 2'-O-methyl phosphorothioate modified
  misc_difference 81: note = guanosine may or may not be 2'-O-methyl phosphorothioate modified
  misc_difference 82: note = guanosine may or may not be 2'-O-methyl phosphorothioate modified
  misc_difference 83: note = cytosine may or may not be 2'-O-methyl phosphorothioate modified
  misc_difference 84: note = adenosine may or may not be 2'-O-methyl phosphorothioate modified
  misc_difference 85: note = cytosine may or may not be 2'-O-methyl phosphorothioate modified
  misc_difference 86: note = cytosine may or may not be 2'-O-methyl phosphorothioate modified
  misc_difference 87: note = guanosine may or may not be 2'-O-methyl phosphorothioate modified
  misc_difference 88: note = adenosine may or may not be 2'-O-methyl phosphorothioate modified
  misc_difference 89: note = guanosine may or may not be 2'-O-methyl phosphorothioate modified
  misc_difference 90: note = uridine may or may not be 2'-O-methyl phosphorothioate modified
  misc_difference 91: note = cytosine may or may not be 2'-O-methyl phosphorothioate modified
  misc_difference 92: note = guanosine may or may not be 2'-O-methyl phosphorothioate modified
  misc_difference 93: note = guanosine may or may not be 2'-O-methyl phosphorothioate modified
  misc_difference 94: note = uridine may or may not be 2'-O-methyl phosphorothioate modified
  misc_difference 95: note = guanosine may or may not be 2'-O-methyl phosphorothioate modified
  misc_difference 96: note = cytosine may or may not be 2'-O-methyl phosphorothioate modified
nnnnnnnnnnnnnnnnnnnngttttagagctagaaatagcaagttaaaataaggctagtccgttatcaacttgaaaaagtggcaccgagtcggtgc

SEQ ID NO: 125503 - RNA, 114 nt, synthetic construct
  source 1..114: mol_type = other RNA; note = chemically synthesized
  misc_difference 1..30: note = modified_base - n is a, c, g, u, or other and this region may encompass 17-30 nucleotides;
  misc_difference 107..114: note = modified_base - This region may encompass 1-8 uracil
  misc_difference 1: note = a, c, g, u, or other may or may not be 2'-O-methyl phosphorothioate modified
  misc_difference 2: note = a, c, g, u, or other may or may not be 2'-O-methyl phosphorothioate modified
  misc_difference 3: note = a, c, g, u, or other may or may not be 2'-O-methyl phosphorothioate modified
  misc_difference 4: note = a, c, g, u, or other may or may not be 2'-O-methyl phosphorothioate modified
  misc_difference 5: note = a, c, g, u, or other may or may not be 2'-O-methyl phosphorothioate modified
  misc_difference 6: note = a, c, g, u, or other may or may not be 2'-O-methyl phosphorothioate modified
  misc_difference 7: note = a, c, g, u, or other may or may not be 2'-O-methyl phosphorothioate modified
  misc_difference 8: note = a, c, g, u, or other may or may not be 2'-O-methyl phosphorothioate modified
  misc_difference 9: note = a, c, g, u, or other may or may not be 2'-O-methyl phosphorothioate modified
  misc_difference 10: note = a, c, g, u, or other may or may not be 2'-O-methyl phosphorothioate modified
  misc_difference 11: note = a, c, g, u, or other may or may not be 2'-O-methyl phosphorothioate modified
  misc_difference 12: note = a, c, g, u, or other may or may not be 2'-O-methyl phosphorothioate modified
  misc_difference 13: note = a, c, g, u, or other may or may not be 2'-O-methyl phosphorothioate modified
  misc_difference 14: note = a, c, g, u, or other may or may not be 2'-O-methyl phosphorothioate modified
  misc_difference 15: note = a, c, g, u, or other may or may not be 2'-O-methyl phosphorothioate modified
  misc_difference 16: note = a, c, g, u, or other may or may not be 2'-O-methyl phosphorothioate modified
  misc_difference 17: note = a, c, g, u, or other may or may not be 2'-O-methyl phosphorothioate modified
  misc_difference 18: note = a, c, g, u, or other may or may not be 2'-O-methyl phosphorothioate modified
  misc_difference 19: note = a, c, g, u, or other may or may not be 2'-O-methyl phosphorothioate modified
  misc_difference 20: note = a, c, g, u, or other may or may not be 2'-O-methyl phosphorothioate modified
  misc_difference 21: note = a, c, g, u, or other may or may not be 2'-O-methyl phosphorothioate modified
  misc_difference 22: note = a, c, g, u, or other may or may not be 2'-O-methyl phosphorothioate modified
  misc_difference 23: note = a, c, g, u, or other may or may not be 2'-O-methyl phosphorothioate modified
  misc_difference 24: note = a, c, g, u, or other may or may not be 2'-O-methyl phosphorothioate modified
  misc_difference 25: note = a, c, g, u, or other may or may not be 2'-O-methyl phosphorothioate modified
  misc_difference 26: note = a, c, g, u, or other may or may not be 2'-O-methyl phosphorothioate modified
  misc_difference 27: note = a, c, g, u, or other may or may not be 2'-O-methyl phosphorothioate modified
  misc_difference 28: note = a, c, g, u, or other may or may not be 2'-O-methyl phosphorothioate modified
  misc_difference 29: note = a, c, g, u, or other may or may not be 2'-O-methyl phosphorothioate modified
  misc_difference 30: note = a, c, g, u, or other may or may not be 2'-O-methyl phosphorothioate modified
  misc_difference 31: note = guanosine may or may not be 2'-O-methyl phosphorothioate modified
  misc_difference 32: note = uridine may or may not be 2'-O-methyl phosphorothioate modified
  misc_difference 33: note = uridine may or may not be 2'-O-methyl phosphorothioate modified
  misc_difference 34: note = uridine may or may not be 2'-O-methyl phosphorothioate modified
  misc_difference 35: note = uridine may or may not be 2'-O-methyl phosphorothioate modified
  misc_difference 36: note = adenosine may or may not be 2'-O-methyl phosphorothioate modified
  misc_difference 37: note = guanosine may or may not be 2'-O-methyl phosphorothioate modified
  misc_difference 38: note = adenosine may or may not be 2'-O-methyl phosphorothioate modified
  misc_difference 39: note = guanosine may or may not be 2'-O-methyl phosphorothioate modified
  misc_difference 40: note = cytosine may or may not be 2'-O-methyl phosphorothioate modified
  misc_difference 41: note = uridine may or may not be 2'-O-methyl phosphorothioate modified
  misc_difference 42: note = adenosine may or may not be 2'-O-methyl phosphorothioate modified
  misc_difference 43: note = guanosine may or may not be 2'-O-methyl phosphorothioate modified
  misc_difference 44: note = adenosine may or may not be 2'-O-methyl phosphorothioate modified
  misc_difference 45: note = adenosine may or may not be 2'-O-methyl phosphorothioate modified
  misc_difference 46: note = adenosine may or may not be 2'-O-methyl phosphorothioate modified
  misc_difference 47: note = uridine may or may not be 2'-O-methyl phosphorothioate modified
  misc_difference 48: note = adenosine may or may not be 2'-O-methyl phosphorothioate modified
  misc_difference 49: note = guanosine may or may not be 2'-O-methyl phosphorothioate modified
  misc_difference 50: note = cytosine may or may not be 2'-O-methyl phosphorothioate modified
  misc_difference 51: note = adenosine may or may not be 2'-O-methyl phosphorothioate modified
  misc_difference 52: note = adenosine may or may not be 2'-O-methyl phosphorothioate modified
  misc_difference 53: note = guanosine may or may not be 2'-O-methyl phosphorothioate modified
  misc_difference 54: note = uridine may or may not be 2'-O-methyl phosphorothioate modified
  misc_difference 55: note = uridine may or may not be 2'-O-methyl phosphorothioate modified
  misc_difference 56: note = adenosine may or may not be 2'-O-methyl phosphorothioate modified
  misc_difference 57: note = adenosine may or may not be 2'-O-methyl phosphorothioate modified
  misc_difference 58: note = adenosine may or may not be 2'-O-methyl phosphorothioate modified
  misc_difference 59: note = adenosine may or may not be 2'-O-methyl phosphorothioate modified
  misc_difference 60: note = uridine may or may not be 2'-O-methyl phosphorothioate modified
  misc_difference 61: note = adenosine may or may not be 2'-O-methyl phosphorothioate modified
  misc_difference 62: note = adenosine may or may not be 2'-O-methyl phosphorothioate modified
  misc_difference 63: note = guanosine may or may not be 2'-O-methyl phosphorothioate modified
  misc_difference 64: note = guanosine may or may not be 2'-O-methyl phosphorothioate modified
  misc_difference 65: note = cytosine may or may not be 2'-O-methyl phosphorothioate modified
  misc_difference 66: note = uridine may or may not be 2'-O-methyl phosphorothioate modified
  misc_difference 67: note = adenosine may or may not be 2'-O-methyl phosphorothioate modified
  misc_difference 68: note = guanosine may or may not be 2'-O-methyl phosphorothioate modified
  misc_difference 69: note = uridine may or may not be 2'-O-methyl phosphorothioate modified
  misc_difference 70: note = cytosine may or may not be 2'-O-methyl phosphorothioate modified
  misc_difference 71: note = cytosine may or may not be 2'-O-methyl phosphorothioate modified
  misc_difference 72: note = guanosine may or may not be 2'-O-methyl phosphorothioate modified
  misc_difference 73: note = uridine may or may not be 2'-O-methyl phosphorothioate modified
  misc_difference 74: note = uridine may or may not be 2'-O-methyl phosphorothioate modified
  misc_difference 75: note = adenosine may or may not be 2'-O-methyl phosphorothioate modified
  misc_difference 76: note = uridine may or may not be 2'-O-methyl phosphorothioate modified
  misc_difference 77: note = cytosine may or may not be 2'-O-methyl phosphorothioate modified
  misc_difference 78: note = adenosine may or may not be 2'-O-methyl phosphorothioate modified
  misc_difference 79: note = adenosine may or may not be 2'-O-methyl phosphorothioate modified
  misc_difference 80: note = cytosine may or may not be 2'-O-methyl phosphorothioate modified
  misc_difference 81: note = uridine may or may not be 2'-O-methyl phosphorothioate modified
  misc_difference 82: note = uridine may or may not be 2'-O-methyl phosphorothioate modified
  misc_difference 83: note = guanosine may or may not be 2'-O-methyl phosphorothioate modified
  misc_difference 84: note = adenosine may or may not be 2'-O-methyl phosphorothioate modified
  misc_difference 85: note = adenosine may or may not be 2'-O-methyl phosphorothioate modified
  misc_difference 86: note = adenosine may or may not be 2'-O-methyl phosphorothioate modified
  misc_difference 87: note = adenosine may or may not be 2'-O-methyl phosphorothioate modified
  misc_difference 88: note = adenosine may or may not be 2'-O-methyl phosphorothioate modified
  misc_difference 89: note = guanosine may or may not be 2'-O-methyl phosphorothioate modified
  misc_difference 90: note = uridine may or may not be 2'-O-methyl phosphorothioate modified
  misc_difference 91: note = guanosine may or may not be 2'-O-methyl phosphorothioate modified
  misc_difference 92: note = guanosine may or may not be 2'-O-methyl phosphorothioate modified
  misc_difference 93: note = cytosine may or may not be 2'-O-methyl phosphorothioate modified
  misc_difference 94: note = adenosine may or may not be 2'-O-methyl phosphorothioate modified
  misc_difference 95: note = cytosine may or may not be 2'-O-methyl phosphorothioate modified
  misc_difference 96: note = cytosine may or may not be 2'-O-methyl phosphorothioate modified
  misc_difference 97: note = guanosine may or may not be 2'-O-methyl phosphorothioate modified
  misc_difference 98: note = adenosine may or may not be 2'-O-methyl phosphorothioate modified
  misc_difference 99: note = guanosine may or may not be 2'-O-methyl phosphorothioate modified
  misc_difference 100: note = uridine may or may not be 2'-O-methyl phosphorothioate modified
  misc_difference 101: note = cytosine may or may not be 2'-O-methyl phosphorothioate modified
  misc_difference 102: note = guanosine may or may not be 2'-O-methyl phosphorothioate modified
  misc_difference 103: note = guanosine may or may not be 2'-O-methyl phosphorothioate modified
  misc_difference 104: note = uridine may or may not be 2'-O-methyl phosphorothioate modified
  misc_difference 105: note = guanosine may or may not be 2'-O-methyl phosphorothioate modified
  misc_difference 106: note = cytosine may or may not be 2'-O-methyl phosphorothioate modified
  misc_difference 107: note = uridine may or may not be 2'-O-methyl phosphorothioate modified
  misc_difference 108: note = uridine may or may not be 2'-O-methyl phosphorothioate modified
  misc_difference 109: note = uridine may or may not be 2'-O-methyl phosphorothioate modified
  misc_difference 110: note = uridine may or may not be 2'-O-methyl phosphorothioate modified
  misc_difference 111: note = uridine may or may not be 2'-O-methyl phosphorothioate modified
  misc_difference 112: note = uridine may or may not be 2'-O-methyl phosphorothioate modified
  misc_difference 113: note = uridine may or may not be 2'-O-methyl phosphorothioate modified
  misc_difference 114: note = uridine may or may not be 2'-O-methyl phosphorothioate modified
nnnnnnnnnnnnnnnnnnnnnnnnnnnnnngttttagagctagaaatagcaagttaaaataaggctagtccgttatcaacttgaaaaagtggcaccgagtcggtgctttttttt
